US012539308B2

(12) United States Patent
Johnson et al.

(10) Patent No.: US 12,539,308 B2
(45) Date of Patent: Feb. 3, 2026

(54) IMMUNE-ENHANCING RNAS FOR COMBINATION WITH CHIMERIC ANTIGEN RECEPTOR THERAPY

(71) Applicants: Novartis AG, Basel (CH); The Trustees of the University of Pennsylvania, Philadelphia, PA (US)

(72) Inventors: Lexus R. Johnson, Philadelphia, PA (US); Carl H. June, Merion Station, PA (US); Andy J. Minn, Philadelphia, PA (US)

(73) Assignees: The Trustees of the University of Pennsylvania, Philadelphia, PA (US); Novartis AG, Basel (CH)

( * ) Notice: Subject to any disclaimer, the term of this patent is extended or adjusted under 35 U.S.C. 154(b) by 1255 days.

(21) Appl. No.: 16/960,508

(22) PCT Filed: Jan. 8, 2019

(86) PCT No.: PCT/US2019/012675
§ 371 (c)(1),
(2) Date: Jul. 7, 2020

(87) PCT Pub. No.: WO2019/136432
PCT Pub. Date: Jul. 11, 2019

(65) Prior Publication Data

US 2020/0368268 A1 Nov. 26, 2020

Related U.S. Application Data

(60) Provisional application No. 62/614,908, filed on Jan. 8, 2018, provisional application No. 62/653,932, filed on Apr. 6, 2018.

(51) Int. Cl.

| | |
|---|---|
| ***C12N 15/117*** | (2010.01) |
| ***A61K 31/7088*** | (2006.01) |
| ***A61K 39/395*** | (2006.01) |
| ***A61K 40/11*** | (2025.01) |
| ***A61K 40/31*** | (2025.01) |
| ***A61K 40/42*** | (2025.01) |
| ***A61P 35/00*** | (2006.01) |
| *A61K 31/4439* | (2006.01) |
| *A61K 39/00* | (2006.01) |
| *A61K 39/39* | (2006.01) |

(52) U.S. Cl.
CPC .... *A61K 31/7088* (2013.01); *A61K 39/39558* (2013.01); *A61K 40/11* (2025.01); *A61K 40/31* (2025.01); *A61K 40/4211* (2025.01); *A61P 35/00* (2018.01); *C12N 15/117* (2013.01); *A61K 31/4439* (2013.01); *A61K 39/39* (2013.01); *A61K 2039/505* (2013.01); *A61K 2039/55561* (2013.01); *A61K 2039/876* (2018.08); *A61K 2239/38* (2023.05); *A61K 2239/57* (2023.05)

(58) Field of Classification Search
CPC .................................................. C12N 15/117
See application file for complete search history.

(56) References Cited

U.S. PATENT DOCUMENTS

| | | | |
|---|---|---|---|
| 5,359,046 | A | 10/1994 | Capon et al. |
| 5,686,281 | A | 11/1997 | Roberts |
| 5,712,149 | A | 1/1998 | Roberts |
| 5,874,240 | A | 2/1999 | Ni et al. |
| 5,906,936 | A | 5/1999 | Eshhar et al. |
| 6,103,521 | A | 8/2000 | Capon et al. |
| 6,319,494 | B1 | 11/2001 | Capon et al. |
| 6,355,779 | B1 | 3/2002 | Goodwin et al. |
| 6,410,319 | B1 | 6/2002 | Raubitschek et al. |
| 6,569,997 | B1 | 5/2003 | Kwon |
| 7,049,136 | B2 | 5/2006 | Seed et al. |
| 7,052,906 | B1 | 5/2006 | Lawson et al. |
| 7,070,995 | B2 | 7/2006 | Jensen |
| 7,265,209 | B2 | 9/2007 | Jensen |
| 7,319,143 | B2 | 1/2008 | Gross et al. |
| 7,320,787 | B2 | 1/2008 | Seed et al. |
| 7,446,190 | B2 | 11/2008 | Sadelain et al. |
| 7,446,191 | B2 | 11/2008 | Jensen |
| 7,514,537 | B2 | 4/2009 | Jensen |
| 7,638,326 | B2 | 12/2009 | June et al. |
| 7,741,465 | B1 | 6/2010 | Eshhar et al. |
| 7,745,140 | B2 | 6/2010 | June et al. |
| 7,754,482 | B2 | 7/2010 | Riley et al. |
| 7,994,298 | B2 | 8/2011 | Zhang et al. |
| 8,211,422 | B2 | 7/2012 | Eshhar et al. |
| 8,252,914 | B2 | 8/2012 | Zhang et al. |
| 8,389,282 | B2 | 3/2013 | Sadelain et al. |

(Continued)

FOREIGN PATENT DOCUMENTS

| | | | |
|---|---|---|---|
| EP | 0574512 | A1 | 12/1993 |
| EP | 0871495 | A1 | 10/1998 |

(Continued)

OTHER PUBLICATIONS

Kochenderfer et al., "Eradication of B-lineage cells and regression of lymphoma in a patient treated with autologous T cells genetically engineered to recognize CD19," Blood 116: 4099-4102 (2010).

(Continued)

*Primary Examiner* — Ekaterina Poliakova-Georgantas
(74) *Attorney, Agent, or Firm* — Saul Ewing LLP; Kathryn Doyle; Alireza Behrooz

(57) ABSTRACT

The invention provides compositions and methods for treating diseases such as cancer. The invention also relates to a method of administering a chimeric antigen receptor (CAR) therapy and an additional therapeutic agent.

24 Claims, 76 Drawing Sheets

Specification includes a Sequence Listing.

(56) References Cited

U.S. PATENT DOCUMENTS

| | | | |
|---|---|---|---|
| 8,399,645 | B2 | 3/2013 | Campana et al. |
| 8,465,743 | B2 | 6/2013 | Rosenberg et al. |
| 8,637,307 | B2 | 1/2014 | June et al. |
| 8,722,400 | B2 | 5/2014 | Riley et al. |
| 8,906,682 | B2 | 12/2014 | June et al. |
| 8,911,993 | B2 | 12/2014 | June et al. |
| 8,916,381 | B1 | 12/2014 | June et al. |
| 8,975,071 | B1 | 3/2015 | June et al. |
| 9,101,584 | B2 | 8/2015 | June et al. |
| 9,102,760 | B2 | 8/2015 | June et al. |
| 9,102,761 | B2 | 8/2015 | June et al. |
| 9,394,368 | B2 | 7/2016 | Brogdon et al. |
| 9,573,988 | B2 | 2/2017 | Brogdon et al. |
| 9,745,368 | B2 | 8/2017 | Milone et al. |
| 9,777,061 | B2 | 10/2017 | Ebersbach et al. |
| 9,815,901 | B2 | 11/2017 | Brogdon et al. |
| 2003/0060444 | A1 | 3/2003 | Finney et al. |
| 2003/0077249 | A1 | 4/2003 | Bebbington et al. |
| 2003/0148982 | A1 | 8/2003 | Brenner et al. |
| 2003/0224520 | A1 | 12/2003 | June et al. |
| 2004/0038886 | A1 | 2/2004 | Finney et al. |
| 2004/0043401 | A1 | 3/2004 | Sadelain et al. |
| 2005/0113564 | A1 | 5/2005 | Campana et al. |
| 2005/0129671 | A1 | 6/2005 | Cooper et al. |
| 2007/0036773 | A1 | 2/2007 | Cooper et al. |
| 2008/0131415 | A1 | 6/2008 | Riddell et al. |
| 2009/0257994 | A1 | 10/2009 | Jensen |
| 2011/0052554 | A1 | 3/2011 | Zakrzewski et al. |
| 2012/0148552 | A1 | 6/2012 | Jensen |
| 2012/0321667 | A1 | 12/2012 | Sentman |
| 2013/0071409 | A1 | 3/2013 | Riley et al. |
| 2013/0071414 | A1 | 3/2013 | Dotti et al. |
| 2013/0149337 | A1 | 6/2013 | Cooper et al. |
| 2013/0155909 | A1 | 6/2013 | Jackson et al. |
| 2013/0287748 | A1 | 10/2013 | June et al. |
| 2014/0050708 | A1 | 2/2014 | Powell et al. |
| 2014/0099309 | A1 | 4/2014 | Powell, Jr. et al. |
| 2014/0099340 | A1 | 4/2014 | June et al. |
| 2014/0106449 | A1 | 4/2014 | June et al. |
| 2014/0186947 | A1 | 7/2014 | June et al. |
| 2014/0212446 | A1 | 7/2014 | Riley et al. |
| 2014/0219975 | A1 | 8/2014 | June et al. |
| 2014/0227237 | A1 | 8/2014 | June et al. |
| 2014/0271635 | A1 | 9/2014 | Brogdon et al. |
| 2014/0322169 | A1 | 10/2014 | Harper et al. |
| 2014/0322183 | A1 | 10/2014 | Milone et al. |
| 2014/0322212 | A1 | 10/2014 | Brogdon et al. |
| 2014/0322275 | A1 | 10/2014 | Brogdon et al. |
| 2014/0370045 | A1 | 12/2014 | June et al. |
| 2015/0017141 | A1 | 1/2015 | June et al. |
| 2015/0140019 | A1 | 5/2015 | June et al. |
| 2015/0190428 | A1 | 7/2015 | June et al. |
| 2015/0202286 | A1 | 7/2015 | June et al. |
| 2015/0283178 | A1 | 10/2015 | June et al. |
| 2015/0290244 | A1 | 10/2015 | June et al. |
| 2015/0342994 | A1 | 12/2015 | Riley et al. |
| 2016/0046724 | A1 | 2/2016 | Brogdon et al. |
| 2016/0051651 | A1 | 2/2016 | Brogdon et al. |
| 2016/0068601 | A1 | 3/2016 | Brogdon et al. |
| 2016/0096892 | A1 | 4/2016 | Brogdon et al. |
| 2016/0185861 | A1 | 6/2016 | Bedoya et al. |
| 2016/0311907 | A1 | 10/2016 | Brogdon et al. |
| 2016/0311917 | A1 | 10/2016 | Beatty et al. |
| 2016/0340406 | A1 | 11/2016 | Zhao et al. |
| 2016/0362472 | A1 | 12/2016 | Bitter et al. |
| 2017/0008963 | A1 | 1/2017 | Brogdon et al. |
| 2017/0081411 | A1 | 3/2017 | Engels et al. |
| 2017/0137783 | A1 | 5/2017 | Bedoya et al. |
| 2017/0183415 | A1 | 6/2017 | Brogdon et al. |
| 2017/0209492 | A1 | 7/2017 | June et al. |
| 2017/0211055 | A1 | 7/2017 | Brogdon et al. |
| 2017/0226495 | A1 | 8/2017 | Guimaraes |
| 2017/0239294 | A1 | 8/2017 | Thomas-Tikhonenko et al. |
| 2017/0260268 | A1 | 9/2017 | Beatty et al. |
| 2017/0274014 | A1 | 9/2017 | Brogdon et al. |
| 2017/0306416 | A1 | 10/2017 | Bedoya et al. |
| 2017/0335281 | A1 | 11/2017 | Loew et al. |
| 2018/0022795 | A1 | 1/2018 | Milone et al. |
| 2018/0044423 | A1 | 2/2018 | Ebersbach et al. |
| 2018/0044424 | A1 | 2/2018 | June et al. |
| 2018/0118834 | A1 | 5/2018 | Brogdon et al. |
| 2018/0125892 | A1 | 5/2018 | Brannetti et al. |
| 2018/0133296 | A1 | 5/2018 | Barrett et al. |
| 2018/0140602 | A1 | 5/2018 | Angst et al. |
| 2018/0230193 | A1 | 8/2018 | Loew et al. |
| 2018/0252727 | A1 | 9/2018 | Garfall et al. |
| 2018/0258149 | A1 | 9/2018 | Motz et al. |
| 2018/0298068 | A1 | 10/2018 | Albelda |
| 2018/0298450 | A1 | 10/2018 | Minn et al. |
| 2018/0312595 | A1 | 11/2018 | Brogdon et al. |
| 2019/0000880 | A1 | 1/2019 | Motz et al. |
| 2019/0000944 | A1 | 1/2019 | Brogdon et al. |
| 2019/0135940 | A1 | 5/2019 | Brogdon et al. |
| 2019/0151365 | A1 | 5/2019 | Anak et al. |
| 2019/0153061 | A1 | 5/2019 | Brogdon et al. |
| 2019/0161542 | A1 | 5/2019 | Gill et al. |
| 2019/0263914 | A1 | 8/2019 | Brogdon et al. |
| 2019/0292238 | A1 | 9/2019 | Bitter et al. |
| 2019/0292257 | A1 | 9/2019 | Bedoya et al. |
| 2019/0298715 | A1 | 10/2019 | Motz et al. |
| 2019/0330356 | A1 | 10/2019 | Brogdon et al. |
| 2019/0336504 | A1 | 11/2019 | Gill et al. |
| 2019/0375815 | A1 | 12/2019 | Engels et al. |
| 2019/0382500 | A1 | 12/2019 | Abujoub et al. |
| 2019/0388471 | A1 | 12/2019 | June et al. |
| 2019/0389928 | A1 | 12/2019 | Posey et al. |
| 2020/0048359 | A1 | 2/2020 | Albelda et al. |
| 2020/0055948 | A1 | 2/2020 | Daley et al. |
| 2020/0061113 | A1 | 2/2020 | Kassim et al. |
| 2020/0085869 | A1 | 3/2020 | Schuster et al. |
| 2020/0087376 | A1 | 3/2020 | Fraietta et al. |
| 2020/0113941 | A1 | 4/2020 | Brannetti et al. |
| 2020/0179511 | A1 | 6/2020 | Daley et al. |
| 2020/0215171 | A1 | 7/2020 | Brogdon et al. |
| 2020/0281973 | A1 | 9/2020 | Dranoff |
| 2020/0283729 | A1 | 9/2020 | Loew et al. |
| 2020/0291354 | A1 | 9/2020 | Johnson et al. |
| 2020/0339704 | A1 | 10/2020 | Bradner et al. |
| 2020/0360431 | A1 | 11/2020 | Garfall et al. |
| 2020/0370012 | A1 | 11/2020 | Fraietta et al. |
| 2020/0371091 | A1 | 11/2020 | Pruteanu-Malinici et al. |
| 2020/0399383 | A1 | 12/2020 | Scholler et al. |
| 2021/0002377 | A1 | 1/2021 | Brogdon et al. |
| 2021/0047405 | A1 | 2/2021 | Nobles et al. |

FOREIGN PATENT DOCUMENTS

| | | | |
|---|---|---|---|
| EP | 1226244 | A2 | 7/2002 |
| WO | 1992015322 | A1 | 9/1992 |
| WO | 199530014 | A1 | 11/1995 |
| WO | 9623814 | A1 | 8/1996 |
| WO | 9624671 | A1 | 8/1996 |
| WO | 1997015669 | A1 | 5/1997 |
| WO | 9723613 | A2 | 7/1997 |
| WO | 9818809 | A1 | 5/1998 |
| WO | 9900494 | A2 | 1/1999 |
| WO | 9957268 | A1 | 11/1999 |
| WO | 0014257 | A1 | 3/2000 |
| WO | 2002033101 | A1 | 4/2002 |
| WO | 02077029 | A2 | 10/2002 |
| WO | 02088334 | A1 | 11/2002 |
| WO | 2003057171 | A2 | 7/2003 |
| WO | 2005019429 | A2 | 3/2005 |
| WO | 2005044996 | A2 | 5/2005 |
| WO | 2005/118788 | A2 | 12/2005 |
| WO | 2006060878 | A1 | 6/2006 |
| WO | 2008045437 | A2 | 4/2008 |
| WO | 2010085660 | A2 | 7/2010 |
| WO | 2011059836 | A2 | 5/2011 |
| WO | 2011097477 | A1 | 8/2011 |
| WO | 2012058460 | A2 | 5/2012 |
| WO | 2012079000 | A1 | 6/2012 |
| WO | 2012082841 | A2 | 6/2012 |
| WO | 2012/099973 | A2 | 7/2012 |

(56) References Cited

FOREIGN PATENT DOCUMENTS

| | | | |
|---|---|---|---|
| WO | 2012127464 | A2 | 9/2012 |
| WO | 2012129514 | A1 | 9/2012 |
| WO | 2012135854 | A2 | 10/2012 |
| WO | 2012138858 | A1 | 10/2012 |
| WO | 2013019615 | A2 | 2/2013 |
| WO | 2013033626 | A2 | 3/2013 |
| WO | 2013040371 | A2 | 3/2013 |
| WO | 2013040557 | A2 | 3/2013 |
| WO | 2013059593 | A1 | 4/2013 |
| WO | 2013/126712 | A1 | 8/2013 |
| WO | 2013126729 | A1 | 8/2013 |
| WO | 2013126733 | A1 | 8/2013 |
| WO | 2014/011984 | A1 | 1/2014 |
| WO | 2014/011987 | A1 | 1/2014 |
| WO | 2014/011993 | A2 | 1/2014 |
| WO | 2014/012001 | A2 | 1/2014 |
| WO | 2014011988 | A2 | 1/2014 |
| WO | 2014011996 | A1 | 1/2014 |
| WO | 2014031687 | A1 | 2/2014 |
| WO | 2014039513 | A2 | 3/2014 |
| WO | 2014/055442 | A2 | 4/2014 |
| WO | 2014055657 | A1 | 4/2014 |
| WO | 2014130635 | A1 | 8/2014 |
| WO | 2014/145252 | A2 | 9/2014 |
| WO | 2014153270 | A1 | 9/2014 |
| WO | 2015090229 | A1 | 6/2015 |
| WO | 2015090230 | A1 | 6/2015 |
| WO | 2015112626 | A1 | 7/2015 |
| WO | 2015/142661 | A1 | 9/2015 |
| WO | 2015142675 | A2 | 9/2015 |
| WO | 2015157252 | A1 | 10/2015 |
| WO | 2016014501 | A1 | 1/2016 |
| WO | 2016014530 | A1 | 1/2016 |
| WO | 2016014535 | A1 | 1/2016 |
| WO | 2016014553 | A1 | 1/2016 |
| WO | 2016014565 | A2 | 1/2016 |
| WO | 2016014576 | A1 | 1/2016 |
| WO | 2016019300 | A1 | 2/2016 |
| WO | 2016025880 | A1 | 2/2016 |
| WO | 2016028896 | A1 | 2/2016 |
| WO | 2016044605 | A1 | 3/2016 |
| WO | 2017173427 | A1 | 10/2017 |
| WO | 2019136432 | A1 | 7/2019 |

OTHER PUBLICATIONS

Kraus et al., “Antigen-dependent CD28 Signaling Selectively Enhances Survival and Proliferation in Genetically Modified Activated Human Primary T Lymphocytes” J. Exp. Med. (1998) vol. 188 Np 4 pp. 619-626.

Kwon et al., “cDNA sequences of two inducible T-cell genes”. Proc. Natl. Acad. Sci. U.S.A. 86(6): 1963-1967 (1989).

Lamanna et al., “Pentostatin, Cyclophosphamide, and Rutuximab Is an Active, Well-Tolerated Regimen for Patients With Previously Treated Chronic Lymphocytic Leukemia” Journal of Clinical Oncology (2008) vol. 24 No 10 pp. 1575-1581.

Lamers et al., “Treatment of Metastatic Renal Cell Carcinoma With Autologous T-Lymphocytes Genetically Retargeted Against Carbonic Anhydrase IX: First Clinical Experience,” J. Clin. Oncol. 24(13): e20-e22 (2006).

Laport et al., “Adoptive transfer of costimulated T cells induces lymphocytosis in patients with relapsed/refractory non-Hodgkin lymphoma following CD34 +-selected hematopoietic cell transplantation” Blood (2003) vol. 102 No. 6 pp. 2004-2013.

Lee et al., “In vivo Inhibition of Human CD19-Targeted Effector T Cells by Natural T Regulatory Cells in a Xenotransplant Murine Model of B Cell Malignancy” Cancer Research (2011) vol. 71 No 8 pp. 2871-2881.

Lee et al., “The Future is Now: Chimeric Antigen Receptors as New Targeted Therapies for Childhood Cancer,” Clin. Cancer Res. 18: 2780-2790 (2012).

Letourneur et al., “T-cell and basophil activation through the cytoplasmic tail of T-cell-receptor zeta family proteins,” Proc. Natl. Acad. Sci. U.S.A 88: 8905-8909 (1991).

Levine et al., “Gene transfer in humans using a conditionally replicating lentiviral vector” PNAS (2006) vol. 103 No. 46 pp. 17372-17377.

Li et al. “Promising Targets for Cancer Immunotherapy: TLRs, RLRs, and STING-Mediated Innate Immune Pathways” International Journal of Molecular Sciences (2017) vol. 18, No. 404, pp. 1-19.

Macallan et al., “Measurement and modeling of human T cell kinetics” European Journal of Immunology (2003) vol. 33 pp. 2316-2326.

Maher et al., “Human T lymphocyte cytotoxicity and proliferation directed by a single chimeric TCRzeta/CD28 receptor,” Nat. Biotechnol. 20: 70-75 (2002).

McGuinness et al., “Anti-tumor activity of human T cells expressing the CC49-zeta chimeric immune receptor,” Hum. Gene Ther. 10: 165-173 (1999).

Milone et al., “Chimeric Receptors Containing CD137 Signal Transduction Domains Mediate Enhanced Survival of T Cells and Increased Antileukemic Efficacy In Vivo” Molecular Therapy (2009) vol. 17 No. 8 pp. 1453-1464.

Molina, “A Decade of Rituximab: Improving Survival Outcomes in Non-Hodgkin’s Lymphoma” Annu. Rev. Med. (2008) vol. 59 pp. 237-250.

Morgan et al., “Case Report of a Serious Adverse Event Following the Administration of T Cells Transduced With a Chimeric Anitgen Receptor Recognizing ErbB2,” Mol. Ther. 18(4): 843-851 (2010).

Moritz and Groner, “A spacer region between the single chain antibody- and the CD3 zeta-chain domain of chimeric T cell receptor components is required for efficient ligand binding and signaling activity,” Gene Therapy 2(8): 539-546 (1995).

Moritz et al., “Cytotoxic T lymphocytes with a grafted recognition specificity for ERBB2-expressing tumor cells” Proc. Natl. Acad. Sci (1994) vol. 91 pp. 4318-4322.

Nabet et al. “Exosome RNA Unshielding Couples Stromal Activation to Pattern Recognition Receptor Signaling in Cancer” Cell (2017) vol. 170, pp. 352-366.

Naldini et al., “In Vivo Gene Delivery and Stable Transduction of Nondividing Cells by a Lentiviral Vector” Science (1996) vol. 272 pp. 263-267.

NCBI accession HM_852952 accessed Sep. 29, 2015 from http://www.ncbi.nlm.nih.gov/nuccore/hm852952.

Nicholson et al., “Construction and Characterisation of a Function CD19 Specific Single Chain Fv Fragment for Immunotherapy of B Lineage Leukaemia and Lymphoma,” Molecular Immunology 34(16-17): 1157-1165 (1997).

Ohno et al. “Expression of miR-17-92 enhances anti-tumor activity of T-cells transduced with the anti-EGFRvIII chimeric antigen receptor in mice bearing human GBM xenografts” Journal of Immunotherapy of Cancer (2013) vol. 1, No. 21, pp. 1-12.

Olive et al. “miR-19 is a key oncogenic component of mir-17-92” Genes & Development (2009) vol. 23, pp. 2839-2849.

Park and Brentjens “Adoptive Immunotherapy for B-cell Malignancies with Autologous Chimeric Antigen Receptor Modified Tumor Targeted T Cells” Discovery Medicine (2010) vol. 9 No. 47 pp. 277-288.

Park et al. “Adoptive Transfer of Chimeric Antigen Receptor Re-directed Cytolytic T Lymphocyte Clones in Patients with Neuroblastoma”, Molecular Therapy (2007) vol. 15 No. 4 pp. 825-833.

Patel et al., “Impact of chimeric immune receptor extracellular protein domains on T cell function” Gene Therapy (1999) vol. 6 pp. 412-419.

Porter et al. “Chimeric Antigen Receptor-Modified T Cells in Chronic Lymphoid Leukemia”, The New England Journal of Medicine (2011) vol. 365 No. 8 pp. 725-733.

Porter et al., “A phase 1 trial of donor lumphocyte infusions expanded and activated ex vivo via CD3/CD28 costimulation” Blood (2006) vol. 107 No. 4 pp. 1325-1331.

Porter et al., “Chimeric Antigen Receptor Therapy for B-cell Malignancies” Journal of Cancer (2011) vol. 2 pp. 331-332.

(56) References Cited

OTHER PUBLICATIONS

Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell transfer" Nature Medicine (2005) vol. 11 No. 11 pp. 1230-1237.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Baeksgaard & Sorensen, "Acute tumor lysis syndrome in solid tumors—a case report and review of the literature" Cancer Chemotherapy Pharmacology (2003) vol. 51 pp. 187-192.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD137 domains", Proc Natl Acad Sci USA (2009) vol. 106 pp. 3360-3365.
Davila et al. "B Cell Aplasia In a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al., "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.

(56) References Cited

OTHER PUBLICATIONS

Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Hekele et al., "Growth Retardation of Tumors By Adoptive Transfer of Cytotoxic T Lymphocytes Reprogrammed by CD44V6-Specific SCFV:zeta-Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Mai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Search Report and Written Opinion for International Application No. PCT/US2019/012675 dated May 3, 2019.
International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
June et al., "Engineering lymphocyte subsets: tools, trials and tribulations" Nat Rev Immunol (2009) vol. 9 No. 10 pp. 704-716.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kochenderfer et al., "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-Of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 689-702.
Kochenderfer et al. "Lymphoma Remissions Caused by Anti-CD19 Chimeric Antigen Receptor T Cells Are Associated With High Serum Interleukin-15 Levels" Journal of Clinical Oncology (2017) vol. 35, No. 16, pp. 1803-1813.

Hairpin (HP) predicted structure

IMMUNE-ENHANCING RNAS FOR COMBINATION WITH CHIMERIC ANTIGEN RECEPTOR THERAPY

RELATED APPLICATIONS

This application is a U.S. National Phase Application under 35 U.S.C. § 371 of International Application No. PCT/US2019/012675, filed Jan. 8, 2019, which claims priority to U.S. Ser. No. 62/614,908, filed Jan. 8, 2018, and U.S. Ser. No. 62/653,932, filed Apr. 6, 2018, the contents of each of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Jan. 7, 2019, is named N2067-7149WO_SL.txt and is 1,080,675 bytes in size.

FIELD OF THE INVENTION

The present invention relates generally to the use of cells engineered to express a chimeric antigen receptor, optionally in combination with an RNA molecule, to treat a disease such as cancer.

BACKGROUND OF THE INVENTION

Recent developments using chimeric antigen receptor (CAR) modified T cell (CART) therapy, which relies on redirecting T cells to a suitable cell-surface molecule on cancer cells, show promising results in harnessing the power of the immune system to treat cancers (see, e.g., Sadelain et al., Cancer Discovery 3:388-398 (2013)).

Given the ongoing need for improved strategies for targeting diseases such as cancer, new compositions and methods for improving CART therapies are highly desirable.

SUMMARY OF THE INVENTION

This disclosure features, at least in part, compositions and methods of treating disorders such as cancer using immune effector cells (e.g., T cells or NK cells) that express a chimeric antigen receptor (CAR) molecule, e.g., a CAR molecule that binds to a tumor antigen, e.g., an antigen expressed on the surface of a solid tumor or a hematological tumor. In one aspect, the invention features use of the CAR-expressing cell therapy in combination with an RNA molecule (e.g., an exogenous RNA molecule), e.g., a stimulatory RNA molecule, e.g., an immune stimulatory RNA molecule. In some embodiments, the RNA molecule is a viral-like double-stranded RNA molecule. In some embodiments, the RNA molecule is a human RN7SL1 RNA molecule or functional variant thereof. In some embodiments, the RNA molecule increases an immune activity. In some embodiments, the RNA molecule may activate antigen presenting cells, such as dendritic cells, and T cells. Without wishing to be bound by theory, in some embodiments, the activity of the RNA molecule is mediated at least in part by its secondary structure (e.g., a double stranded structure, e.g., a hairpin structure), and a variety of nucleotide sequences would have such activity.

In one aspect, disclosed herein is a method of treating a subject having a disease associated with expression of a first antigen, e.g., a first tumor antigen, e.g., a method of treating a subject having a cancer, comprising administering to the subject an effective number of a cell (e.g., a population of cells) that expresses a chimeric antigen receptor (CAR) molecule that binds to the first antigen, e.g., the first tumor antigen (a "CAR-expressing cell"), in combination with an RNA molecule (e.g., an exogenous RNA molecule), or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene.

In one aspect, disclosed herein is a method of providing an anti-cancer immune response in a subject having a cancer, comprising administering to the subject an effective number of a cell (e.g., a population of cells) that expresses a chimeric antigen receptor (CAR) molecule that binds to a first antigen, e.g., a first tumor antigen (a "CAR-expressing cell"), in combination with an RNA molecule (e.g., an exogenous RNA molecule), or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene.

In some embodiments, the first RNA sequence is at least 25, 30, 35, 40, 45, or 50 nucleotides in length. In some embodiments, the second RNA sequence is at least 25, 30, 35, 40, 45, or 50 nucleotides in length. In some embodiments, the first RNA sequence is at least 25, 30, 35, 40, 45, or 50 nucleotides in length; and the second RNA sequence is at least 25, 30, 35, 40, 45, or 50 nucleotides in length.

In some embodiments, the first RNA sequence and the second RNA sequence form a double-stranded RNA molecule. In some embodiments, the first RNA sequence and the second RNA sequence form a double-stranded RNA molecule of at least 20, 25, 30, 35, 40, 45, or 50 base pairs in length.

In some embodiments, the first RNA sequence is 100% complementary to the second RNA sequence.

In some embodiments, the first RNA sequence and the second RNA sequence are disposed on a single RNA molecule. In some embodiments, the first RNA sequence and the second RNA sequence form a hairpin structure. In some embodiments, the first RNA sequence and the second RNA sequence form a stem-loop structure. In some embodiments, the stem is of at least 20, 25, 30, 35, 40, 45, or 50 base pairs in length. In some embodiments, the loop is 2-10, 3-8, or 4-6 nucleotides in length.

In some embodiments, the first RNA sequence and the second RNA sequence are disposed on separate RNA molecules.

In some embodiments, the RNA molecule comprises one or more Alu domains. In some embodiments, the Alu domain comprises the amino acid sequence of SEQ ID NO: 4 or 6 (or a sequence at least about 85%, 90%, 95%, 99% or more identical thereto, and/or having one, two, three or more substitutions, insertions, deletions, or modifications). In some embodiments, the Alu domain comprises the amino acid sequence of SEQ ID NO: 4 or 6.

In some embodiments, the RNA molecule comprises the nucleotide sequence of SEQ ID NO: 2, 4, 6, 8, 10, or functional variant thereof. In some embodiments, the RNA molecule comprises a nucleotide sequence chosen from SEQ ID NO: 2, 4, 6, 8, or 10 (or a sequence at least about 85%, 90%, 95%, 99% or more identical thereto, and/or having one, two, three or more substitutions, insertions, deletions, or modifications). In some embodiments, the RNA molecule comprises a nucleotide sequence chosen from SEQ ID NO: 2, 4, 6, 8, or 10. In some embodiments, the RNA molecule comprises the nucleotide sequence of SEQ ID NO: 2. In some embodiments, the RNA molecule comprises the nucleotide sequence of SEQ ID NO: 4. In some embodiments, the RNA molecule comprises the nucleotide sequence of SEQ ID NO: 6. In some embodiments, the RNA molecule comprises the nucleotide sequence of SEQ ID NO: 8. In some embodiments, the RNA molecule comprises the nucleotide sequence of SEQ ID NO: 10.

In some embodiments, the nucleic acid molecule encoding the RNA molecule comprises the nucleotide sequence of SEQ ID NO: 1, 3, 5, 7, 9, or functional variant thereof. In some embodiments, the nucleic acid molecule encoding the RNA molecule comprises a nucleotide sequence chosen from SEQ ID NO: 1, 3, 5, 7, or 9 (or a sequence at least about 85%, 90%, 95%, 99% or more identical thereto, and/or having one, two, three or more substitutions, insertions, deletions, or modifications).

In some embodiments, the nucleic acid molecule encoding the RNA molecule comprises a nucleotide sequence chosen from SEQ ID NO: 1, 3, 5, 7, or 9. In some embodiments, the nucleic acid molecule encoding the RNA molecule comprises the nucleotide sequence of SEQ ID NO: 1. In some embodiments, the nucleic acid molecule encoding the RNA molecule comprises the nucleotide sequence of SEQ ID NO: 3. In some embodiments, the nucleic acid molecule encoding the RNA molecule comprises the nucleotide sequence of SEQ ID NO: 5. In some embodiments, the nucleic acid molecule encoding the RNA molecule comprises the nucleotide sequence of SEQ ID NO: 7. In some embodiments, the nucleic acid molecule encoding the RNA molecule comprises the nucleotide sequence of SEQ ID NO: 9.

In some embodiments, the RNA molecule comprises a 5'-triphosphate (5'ppp).

In some embodiments, the RNA molecule comprises at least one chemically modified nucleotide.

In some embodiments, the nucleic acid molecule encoding the RNA molecule is a DNA molecule.

In some embodiments, the RNA molecule, or the nucleic acid molecule encoding the RNA molecule, is linked to a moiety, e.g., a targeting moiety that binds to a tumor antigen or a tissue antigen, e.g., a moiety that binds to the first antigen, e.g., the first tumor antigen. In some embodiments, the subject has a tumor and the moiety targets the RNA molecule, or the nucleic acid molecule encoding the RNA molecule, to the tumor or a tumor microenvironment.

In some embodiments, the RNA molecule, or the nucleic acid molecule encoding the RNA molecule, is administered systemically. In some embodiments, the RNA molecule, or the nucleic acid molecule encoding the RNA molecule, is administered locally. In some embodiments, the subject has a tumor and the RNA molecule, or the nucleic acid molecule encoding the RNA molecule, is administered through intratumoral administration.

In some embodiments, the method comprises administering the nucleic acid molecule encoding the RNA molecule, wherein the expression of the RNA molecule is inducible. In some embodiments, the subject has a tumor and the expression of the RNA molecule is inducible in the tumor or a tumor microenvironment.

In some embodiments, the RNA molecule, or the nucleic acid molecule encoding the RNA molecule, is administered in a vesicle, e.g., an exosome, a liposome, or a cell.

In some embodiments, the RNA molecule, or the nucleic acid molecule encoding the RNA molecule, is disposed in the same cell as the CAR molecule.

In some embodiments, the cell comprises a first nucleic acid molecule (e.g., a first exogenous nucleic acid molecule) encoding the CAR molecule and a second nucleic acid molecule (e.g., a second exogenous nucleic acid molecule) comprising the nucleic acid molecule encoding the RNA molecule.

In some embodiments, the first nucleic acid molecule and the second nucleic acid molecule are disposed on a single nucleic acid molecule. In some embodiments, the single nucleic acid molecule has the following arrangement in an N- to C-terminal orientation: the second nucleic acid molecule—a linker—the first nucleic acid molecule. In some embodiments, the linker encodes a self-cleavage site. In some embodiments, the linker encodes a P2A site, a T2A site, an E2A site, or an F2A site. In some embodiments, the linker encodes a P2A site. In some embodiments, the linker comprises the nucleotide sequence of SEQ ID NO: 23 (or a sequence at least about 85%, 90%, 95%, 99% or more identical thereto, and/or having one, two, three or more substitutions, insertions, deletions, or modifications). In some embodiments, the second nucleic acid molecule comprises the nucleotide sequence of SEQ ID NO: 9 (or a sequence at least about 85%, 90%, 95%, 99% or more identical thereto, and/or having one, two, three or more substitutions, insertions, deletions, or modifications).

In some embodiments, the first nucleic acid molecule and the second nucleic acid molecule are disposed on separate nucleic acid molecules. In some embodiments, the cell comprises a third nucleic acid molecule encoding a synNotch polypeptide. In some embodiments, the synNotch polypeptide comprises (i) an extracellular domain comprising a second antigen binding domain that is not naturally present in a Notch receptor polypeptide and that specifically binds to a second antigen, e.g., a second tumor antigen. In some embodiments, the second antigen is the same as the first antigen. In some embodiments, the second antigen is different from the first antigen. In some embodiments, the synNotch polypeptide further comprises (ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site. In some embodiments, the synNotch polypeptide further comprises (iii) an intracellular domain comprising a transcriptional factor. In some embodiments, binding of the second antigen binding domain to the second antigen, e.g., the second tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein the transcriptional factor, once released, activates the transcription of the nucleic acid molecule encoding the RNA molecule. In some embodiments, (a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence. In some embodiments, (1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In some embodiments, the RNA molecule, or the nucleic acid molecule encoding the RNA molecule, is disposed in a different cell as the CAR molecule. In some embodiments, the cell comprising the RNA molecule, or the nucleic acid molecule encoding the RNA molecule further comprises a nucleic acid molecule encoding a synNotch polypeptide, wherein the synNotch polypeptide comprises:

(i) an extracellular domain comprising a second antigen binding domain that is not naturally present in a Notch receptor polypeptide and that specifically binds to a second antigen, e.g., a second tumor antigen, optionally wherein the second antigen is the same as the first antigen, or the second antigen is different from the first antigen;

(ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site; and (iii) an intracellular domain comprising a transcriptional factor, wherein:

binding of the second antigen binding domain to the second antigen, e.g., the second tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein:

the transcriptional factor, once released, activates the transcription of the nucleic acid molecule encoding the RNA molecule, optionally wherein:

(a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence, optionally wherein:

(1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In some embodiments, the CAR molecule comprises, in an N- to C-terminal orientation, a first antigen binding domain that binds to the first antigen, e.g., the first tumor antigen, a transmembrane domain, and an intracellular signaling domain, optionally wherein the first antigen binding domain is connected to the transmembrane domain by a hinge domain.

In some embodiments, the first or second antigen is chosen from: CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen; Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene polypeptide consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); or immunoglobulin lambda-like polypeptide 1 (IGLL1).

In some embodiments, the first or second antigen is chosen from CD19, CD22, BCMA, CD20, CD123, EGFRvIII, or mesothelin. In some embodiments, the first or second antigen is CD19. In some embodiments, the first or second antigen is BCMA. In some embodiments, the first or second antigen is EGFRvIII. In some embodiments, the first or second antigen is mesothelin.

In some embodiments, the transmembrane domain comprises a transmembrane domain of a protein chosen from the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137 or CD154. In some embodiments, the transmembrane domain comprises a transmembrane domain of CD8. In some embodiments, the transmembrane domain comprises the amino acid sequence of SEQ ID NO: 635 (or a sequence at least about 85%, 90%, 95%, 99% or more identical thereto, and/or having one, two, three or more substitutions, insertions or deletions, e.g., conserved substitutions). In some embodiments, the transmembrane domain comprises the amino acid sequence of SEQ ID NO: 635.

In some embodiments, the intracellular signaling domain comprises a primary signaling domain. In some embodiments, the primary signaling domain comprises a functional signaling domain derived from CD3 zeta, TCR zeta, FcR gamma, FcR beta, CD3 gamma, CD3 delta, CD3 epsilon, CD5, CD22, CD79a, CD79b, CD278 (ICOS), FcεRI, DAP10, DAP12, or CD66d. In some embodiments, the primary signaling domain comprises a functional signaling domain derived from CD3 zeta. In some embodiments, the primary signaling domain comprises the amino acid sequence of SEQ ID NO: 641 or 643 (or a sequence at least about 85%, 90%, 95%, 99% or more identical thereto, and/or having one, two, three or more substitutions, insertions or deletions, e.g., conserved substitutions). In some embodiments, the primary signaling domain comprises the amino acid sequence of SEQ ID NO: 641 or 643.

In some embodiments, the intracellular signaling domain comprises a costimulatory domain. In some embodiments, the costimulatory domain comprises a functional signaling domain derived from MHC class I molecule, TNF receptor protein, Immunoglobulin-like protein, cytokine receptor, integrin, signalling lymphocytic activation molecule (SLAM), activating NK cell receptor, BTLA, a Toll ligand receptor, OX40, CD2, CD7, CD27, CD28, CD30, CD40, CD5, ICAM-1, 4-1BB (CD137), B7-H3, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, or a ligand that specifically binds with CD83. In some embodiments, the costimulatory domain comprises a functional signaling domain derived from 4-1BB. In some embodiments, the costimulatory domain comprises the amino acid sequence of SEQ ID NO: 637 (or a sequence at least about 85%, 90%, 95%, 99% or more identical thereto, and/or having one, two, three or more substitutions, insertions or deletions, e.g., conserved substitutions). In some embodiments, the costimulatory domain comprises the amino acid sequence of SEQ ID NO: 637.

In some embodiments, the RNA molecule, or the nucleic acid molecule encoding the RNA molecule, and the CAR-expressing cell are administered simultaneously. In some embodiments, the RNA molecule, or the nucleic acid molecule encoding the RNA molecule, and the CAR-expressing cell are administered sequentially, e.g., the RNA molecule, or the nucleic acid molecule encoding the RNA molecule, is administered prior to or subsequent to the administration of the CAR-expressing cell.

In some embodiments, the method further comprises administering a third therapeutic agent. In some embodiments, the third therapeutic agent is administered prior to the administration of the RNA molecule, or the nucleic acid molecule encoding the RNA molecule. In some embodiments, the third therapeutic agent is administered subsequent to the administration of the RNA molecule, or the nucleic acid molecule encoding the RNA molecule. In some embodiments, the third therapeutic agent and the RNA molecule are administered simultaneously. In some embodiments, the third therapeutic agent and the nucleic acid molecule encoding the RNA molecule are administered simultaneously. In some embodiments, the third therapeutic agent is administered prior to the administration of the CAR-expressing cell. In some embodiments, the third therapeutic agent is administered subsequent to the administration of the CAR-expressing cell. In some embodiments, the third therapeutic agent and the CAR-expressing cell are administered simultaneously.

In some embodiments, the third therapeutic agent is an inhibitor of a pro-M2 macrophage molecule.

In some embodiments, the third therapeutic agent is chosen from an IL-13 inhibitor, an IL-4 inhibitor, an IL-13Rα1 inhibitor, an IL-4Rα inhibitor, an IL-10 inhibitor, a CSF-1 inhibitor, a CSF1R inhibitor, a TGF beta inhibitor, a JAK2 inhibitor, a cell surface molecule, an iron oxide, a small molecule inhibitor, a PI3K inhibitor, an HDAC inhibitor, an inhibitor of the glycolytic pathway, a mitochondria-targeted antioxidant, a clodronate liposome, or combinations thereof. In some embodiments, the third therapeutic agent is a CSF1R inhibitor. In some embodiments, the third therapeutic agent is an antibody molecule that binds to CSF1R. In some embodiments, the third therapeutic agent is a small molecule inhibitor of CSF1R. In some embodiments, the third therapeutic agent is BLZ945.

In some embodiments, the third therapeutic agent is a checkpoint modulator, optionally wherein the third therapeutic agent is an anti-PD-1 antibody molecule, an anti-PD-L1 antibody molecule, an anti-CTLA-4 antibody molecule, an anti-TIM-3 antibody molecule, or an anti-LAG-3 antibody molecule. In some embodiments, the checkpoint modulator is administered after the administration of the RNA molecule, or the nucleic acid molecule encoding the RNA molecule. In some embodiments, the checkpoint modulator is administered prior to the administration of the RNA molecule, or the nucleic acid molecule encoding the RNA molecule. In some embodiments, the checkpoint modulator and the RNA molecule are administered simultaneously. In some embodiments, the checkpoint modulator and the nucleic acid molecule encoding the RNA molecule are administered simultaneously. In some embodiment, the checkpoint modulator is administered after the administration of the CAR-expressing cell. In some embodiment, the checkpoint modulator is administered prior to the administration of the CAR-expressing cell. In some embodiment, the checkpoint modulator and the CAR-expressing cell are administered simultaneously.

In some embodiments, the third therapeutic agent is a Flt3 ligand polypeptide.

In some embodiments, the administration of the RNA molecule enhances the activity of the third therapeutic agent in the subject, e.g., by at least 20, 40, 60, 80, 100, 500, or 1000%. In some embodiments, the administration of the CAR-expressing cell enhances the activity of the third therapeutic agent in the subject, e.g., by at least 20, 40, 60, 80, 100, 500, or 1000%. In some embodiments, the third therapeutic agent is a checkpoint modulator. In some embodiments, the third therapeutic agent is an anti-PD-1 antibody molecule, an anti-PD-L1 antibody molecule, an anti-CTLA-4 antibody molecule, an anti-TIM-3 antibody molecule, or an anti-LAG-3 antibody molecule. In some embodiments, the third therapeutic agent is an anti-PD-1 antibody molecule. In some embodiments, the third therapeutic agent is an anti-CTLA-4 antibody molecule. In some embodiments, the enhancement occurs in a subject having endogenous T cells. In some embodiments, the enhancement occurs through activation of endogenous T cells.

In some embodiments, the disease associated with expression of a first antigen is a cancer. In some embodiments, the cancer exhibits heterogeneous expression of tumor antigens, e.g., wherein less than 90%, 80%, 70%, 60%, or 50% of cells in the cancer express the first tumor antigen, or wherein less than 90%, 80%, 70%, 60%, or 50% of cells in the cancer are responsive to the CAR-expressing cell. In some embodiments, the cancer is chosen from mesothelioma (e.g., malignant pleural mesothelioma); lung cancer (e.g., non-small cell lung cancer, small cell lung cancer, squamous cell lung cancer, or large cell lung cancer); pancreatic cancer (e.g., pancreatic ductal adenocarcinoma, or metastatic pancreatic ductal adenocarcinoma (PDA)); esophageal adenocarcinoma, ovarian cancer (e.g., serous epithelial ovarian cancer), breast cancer, colorectal cancer, bladder cancer or any combination thereof. In some embodiments, the cancer is a hematological cancer, e.g., a hematological cancer chosen from a leukemia or lymphoma, e.g., the cancer is chosen from chronic lymphocytic leukemia (CLL), mantle cell lymphoma (MCL), multiple myeloma, acute lymphoid leukemia (ALL), Hodgkin lymphoma, B-cell acute lymphoid leukemia (BALL), T-cell acute lymphoid leukemia (TALL), small lymphocytic leukemia (SLL), B cell prolymphocytic leukemia, blastic plasmacytoid dendritic cell neoplasm, Burkitt's lymphoma, diffuse large B cell lymphoma (DLBCL), DLBCL associated with chronic inflammation, chronic myeloid leukemia, myeloproliferative neoplasms, follicular lymphoma, pediatric follicular lymphoma, hairy cell leukemia, small cell- or a large cell-follicular lymphoma, malignant lymphoproliferative conditions, MALT lymphoma (extranodal marginal zone lymphoma of mucosa-associated lymphoid tissue), Marginal zone lymphoma, myelodysplasia, myelodysplastic syndrome, non-Hodgkin lymphoma, plasmablastic lymphoma, plasmacytoid dendritic cell neoplasm, Waldenstrom macroglobulinemia, splenic marginal zone lymphoma, splenic lymphoma/leukemia, splenic diffuse red pulp small B-cell lymphoma, hairy cell leukemia-variant, lymphoplasmacytic lymphoma, a heavy chain disease, plasma cell myeloma, solitary plasmocytoma of bone, extraosseous plasmocytoma, nodal marginal zone lymphoma, pediatric nodal marginal zone lymphoma, primary cutaneous follicle center lymphoma, lymphomatoid granulomatosis, primary mediastinal (thymic) large B-cell lymphoma, intravascular large B-cell lymphoma, ALK+ large B-cell lymphoma, large B-cell lymphoma arising in HHV8-associated multicentric Castleman disease, primary effusion lymphoma, B-cell lymphoma, acute myeloid leukemia (AML), or unclassifiable lymphoma.

In one aspect, disclosed herein is a nucleic acid molecule (e.g., an exogenous nucleic acid molecule) comprising (1) a first nucleic acid molecule (e.g., a first exogenous nucleic acid molecule) encoding a chimeric antigen receptor (CAR) molecule that binds to a first antigen, e.g., a first tumor antigen, and (2) a second nucleic acid molecule (e.g., a second exogenous nucleic acid molecule) comprising an RNA molecule (e.g., an exogenous RNA molecule) or a nucleic acid molecule encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene.

In one aspect, disclosed herein is a cell, e.g., an immune cell, e.g., a T cell or NK cell, comprising (1) a first nucleic acid molecule (e.g., a first exogenous nucleic acid molecule) encoding a chimeric antigen receptor (CAR) molecule that binds to a first antigen, e.g., a first tumor antigen, and (2) a second nucleic acid molecule (e.g., a second exogenous nucleic acid molecule) comprising an RNA molecule (e.g., an exogenous RNA molecule) or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene.

In one aspect, the invention provides a population of cells comprising (1) a first cell, e.g., an immune cell, e.g., a T cell or NK cell, comprising a first nucleic acid molecule (e.g., a first exogenous nucleic acid molecule) encoding a chimeric antigen receptor (CAR) molecule that binds to a first antigen, e.g., a first tumor antigen, and (2) a second cell comprising a second nucleic acid molecule (e.g., a second exogenous nucleic acid molecule) comprising an RNA molecule (e.g., an exogenous RNA molecule) or a nucleic acid molecule (e.g., an exogenous nucleic acid molecule) encoding the RNA molecule, wherein the RNA molecule comprises a first RNA sequence (e.g., a first exogenous RNA sequence) and a second RNA sequence (e.g., a second exogenous RNA sequence), wherein the first RNA sequence is at least 80%, 85%, or 90% complementary to the second RNA sequence, wherein the first RNA sequence is at least 20 nucleotides in length and the second RNA sequence is at least 20 nucleotides in length, wherein the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene. In some embodiments, the first nucleic acid molecule and the second nucleic acid molecule are disposed in different cells. In some embodiments, the second cell further comprises a third nucleic acid molecule encoding a synNotch polypeptide, wherein the synNotch polypeptide comprises:

(i) an extracellular domain comprising a second antigen binding domain that is not naturally present in a Notch receptor polypeptide and that specifically binds to a second antigen, e.g., a second tumor antigen, optionally wherein the second antigen is the same as the first antigen, or the second antigen is different from the first antigen;

(ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site; and (iii) an intracellular domain comprising a transcriptional factor, wherein:

binding of the second antigen binding domain to the second antigen, e.g., the second tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein:

the transcriptional factor, once released, activates the transcription of the nucleic acid molecule encoding the RNA molecule, optionally wherein:

(a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence, optionally wherein:

(1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In some embodiments, the first RNA sequence is at least 25, 30, 35, 40, 45, or 50 nucleotides in length. In some embodiments, the second RNA sequence is at least 25, 30, 35, 40, 45, or 50 nucleotides in length. In some embodiments, the first RNA sequence is at least 25, 30, 35, 40, 45, or 50 nucleotides in length; and the second RNA sequence is at least 25, 30, 35, 40, 45, or 50 nucleotides in length.

In some embodiments, the first RNA sequence and the second RNA sequence form a double-stranded RNA molecule. In some embodiments, the first RNA sequence and the second RNA sequence form a double-stranded RNA molecule of at least 20, 25, 30, 35, 40, 45, or 50 base pairs in length.

In some embodiments, the first RNA sequence is 100% complementary to the second RNA sequence.

In some embodiments, the first RNA sequence and the second RNA sequence are disposed on a single RNA molecule. In some embodiments, the first RNA sequence and the second RNA sequence form a hairpin structure. In some embodiments, the first RNA sequence and the second RNA sequence form a stem-loop structure. In some embodiments, the stem is of at least 20, 25, 30, 35, 40, 45, or 50 base pairs in length. In some embodiments, the loop is 2-10, 3-8, or 4-6 nucleotides in length.

In some embodiments, the first RNA sequence and the second RNA sequence are disposed on separate RNA molecules.

In some embodiments, the RNA molecule comprises one or more Alu domains. In some embodiments, the Alu domain comprises the amino acid sequence of SEQ ID NO: 4 or 6 (or a sequence at least about 85%, 90%, 95%, 99% or more identical thereto, and/or having one, two, three or more substitutions, insertions, deletions, or modifications). In some embodiments, the Alu domain comprises the amino acid sequence of SEQ ID NO: 4 or 6.

In some embodiments, the RNA molecule comprises the nucleotide sequence of SEQ ID NO: 2, 4, 6, 8, 10, or functional variant thereof. In some embodiments, the RNA molecule comprises a nucleotide sequence chosen from SEQ ID NO: 2, 4, 6, 8, or 10 (or a sequence at least about 85%, 90%, 95%, 99% or more identical thereto, and/or having one, two, three or more substitutions, insertions, deletions, or modifications). In some embodiments, the RNA molecule comprises a nucleotide sequence chosen from SEQ ID NO: 2, 4, 6, 8, or 10. In some embodiments, the RNA molecule comprises the nucleotide sequence of SEQ ID NO: 2. In some embodiments, the RNA molecule comprises the nucleotide sequence of SEQ ID NO: 4. In some embodiments, the RNA molecule comprises the nucleotide sequence of SEQ ID NO: 6. In some embodiments, the RNA molecule comprises the nucleotide sequence of SEQ ID NO: 8. In some embodiments, the RNA molecule comprises the nucleotide sequence of SEQ ID NO: 10.

In some embodiments, the nucleic acid molecule encoding the RNA molecule comprises the nucleotide sequence of SEQ ID NO: 1, 3, 5, 7, 9, or functional variant thereof. In some embodiments, the nucleic acid molecule encoding the RNA molecule comprises a nucleotide sequence chosen from SEQ ID NO: 1, 3, 5, 7, or 9 (or a sequence at least about 85%, 90%, 95%, 99% or more identical thereto, and/or having one, two, three or more substitutions, insertions, deletions, or modifications).

In some embodiments, the nucleic acid molecule encoding the RNA molecule comprises a nucleotide sequence chosen from SEQ ID NO: 1, 3, 5, 7, or 9. In some embodiments, the nucleic acid molecule encoding the RNA molecule comprises the nucleotide sequence of SEQ ID NO: 1. In some embodiments, the nucleic acid molecule encoding the RNA molecule comprises the nucleotide sequence of SEQ ID NO: 3. In some embodiments, the nucleic acid molecule encoding the RNA molecule comprises the nucleotide sequence of SEQ ID NO: 5. In some embodiments, the nucleic acid molecule encoding the RNA molecule comprises the nucleotide sequence of SEQ ID NO: 7. In some embodiments, the nucleic acid molecule encoding the RNA molecule comprises the nucleotide sequence of SEQ ID NO: 9.

In some embodiments, the RNA molecule comprises a 5'-triphosphate (5'ppp).

In some embodiments, the RNA molecule comprises at least one chemically modified nucleotide.

In some embodiments, the nucleic acid molecule encoding the RNA molecule is a DNA molecule.

In some embodiments, the RNA molecule, or the nucleic acid molecule encoding the RNA molecule, is linked to a moiety, e.g., a targeting moiety that binds to a tumor antigen or a tissue antigen, e.g., a moiety that binds to the first antigen, e.g., the first tumor antigen.

In some embodiments, the nucleic acid molecule or cell comprises the nucleic acid molecule encoding the RNA molecule, wherein the expression of the RNA molecule is inducible.

In some embodiments, the first nucleic acid molecule and the second nucleic acid molecule are disposed on a single nucleic acid molecule. In some embodiments, the single nucleic acid molecule has the following arrangement in an N- to C-terminal orientation: the second nucleic acid molecule—a linker—the first nucleic acid molecule. In some embodiments, the linker encodes a self-cleavage site. In some embodiments, the linker encodes a P2A site, a T2A site, an E2A site, or an F2A site. In some embodiments, the linker encodes a P2A site. In some embodiments, the linker comprises the nucleotide sequence of SEQ ID NO: 23 (or a sequence at least about 85%, 90%, 95%, 99% or more identical thereto, and/or having one, two, three or more substitutions, insertions, deletions, or modifications). In some embodiments, the second nucleic acid molecule comprises the nucleotide sequence of SEQ ID NO: 9 (or a sequence at least about 85%, 90%, 95%, 99% or more identical thereto, and/or having one, two, three or more substitutions, insertions, deletions, or modifications).

In some embodiments, the first nucleic acid molecule and the second nucleic acid molecule are disposed on separate nucleic acid molecules. In some embodiments, the cell comprises a third nucleic acid molecule encoding a synNotch polypeptide. In some embodiments, the synNotch polypeptide comprises (i) an extracellular domain comprising a second antigen binding domain that is not naturally present in a Notch receptor polypeptide and that specifically binds to a second antigen, e.g., a second tumor antigen. In some embodiments, the second antigen is the same as the first antigen. In some embodiments, the second antigen is different from the first antigen. In some embodiments, the synNotch polypeptide further comprises (ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site. In some embodiments, the synNotch polypeptide further comprises (iii) an intracellular domain comprising a transcriptional factor. In some embodiments, binding of the second antigen binding domain to the second antigen, e.g., the second tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein the transcriptional factor, once released, activates the transcription of the nucleic acid molecule encoding the RNA molecule. In some embodiments, (a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence. In some embodiments, (1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In some embodiments, the CAR molecule comprises, in an N- to C-terminal orientation, a first antigen binding domain that binds to the first antigen, e.g., the first tumor antigen, a transmembrane domain, and an intracellular signaling domain, optionally wherein the first antigen binding domain is connected to the transmembrane domain by a hinge domain.

In some embodiments, the first or second antigen is chosen from: CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen; Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene polypeptide consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1);

ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); or immunoglobulin lambda-like polypeptide 1 (IGLL1).

In some embodiments, the first or second antigen is chosen from CD19, CD22, BCMA, CD20, CD123, EGFRvIII, or mesothelin. In some embodiments, the first or second antigen is CD19. In some embodiments, the first or second antigen is BCMA. In some embodiments, the first or second antigen is EGFRvIII. In some embodiments, the first or second antigen is mesothelin.

In some embodiments, the transmembrane domain comprises a transmembrane domain of a protein chosen from the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137 or CD154. In some embodiments, the transmembrane domain comprises a transmembrane domain of CD8. In some embodiments, the transmembrane domain comprises the amino acid sequence of SEQ ID NO: 635 (or a sequence at least about 85%, 90%, 95%, 99% or more identical thereto, and/or having one, two, three or more substitutions, insertions or deletions, e.g., conserved substitutions). In some embodiments, the transmembrane domain comprises the amino acid sequence of SEQ ID NO: 635.

In some embodiments, the intracellular signaling domain comprises a primary signaling domain. In some embodiments, the primary signaling domain comprises a functional signaling domain derived from CD3 zeta, TCR zeta, FcR gamma, FcR beta, CD3 gamma, CD3 delta, CD3 epsilon, CD5, CD22, CD79a, CD79b, CD278 (ICOS), FcεRI, DAP10, DAP12, or CD66d. In some embodiments, the primary signaling domain comprises a functional signaling domain derived from CD3 zeta. In some embodiments, the primary signaling domain comprises the amino acid sequence of SEQ ID NO: 641 or 643 (or a sequence at least about 85%, 90%, 95%, 99% or more identical thereto, and/or having one, two, three or more substitutions, insertions or deletions, e.g., conserved substitutions). In some embodiments, the primary signaling domain comprises the amino acid sequence of SEQ ID NO: 641 or 643.

In some embodiments, the intracellular signaling domain comprises a costimulatory domain. In some embodiments, the costimulatory domain comprises a functional signaling domain derived from MHC class I molecule, TNF receptor protein, Immunoglobulin-like protein, cytokine receptor, integrin, signalling lymphocytic activation molecule (SLAM), activating NK cell receptor, BTLA, a Toll ligand receptor, OX40, CD2, CD7, CD27, CD28, CD30, CD40, CD5, ICAM-1, 4-1BB (CD137), B7-H3, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, or a ligand that specifically binds with CD83. In some embodiments, the costimulatory domain comprises a functional signaling domain derived from 4-1BB. In some embodiments, the costimulatory domain comprises the amino acid sequence of SEQ ID NO: 637 (or a sequence at least about 85%, 90%, 95%, 99% or more identical thereto, and/or having one, two, three or more substitutions, insertions or deletions, e.g., conserved substitutions). In some embodiments, the costimulatory domain comprises the amino acid sequence of SEQ ID NO: 637.

In one aspect, the invention provides a pharmaceutical composition comprising a nucleic acid molecule (e.g., an exogenous nucleic acid molecule) or cell disclosed herein and a pharmaceutically acceptable carrier, excipient, or stabilizer.

In one aspect, the invention provides a method of treating a subject having a disease associated with expression of a first antigen, e.g., a first tumor antigen, e.g., a method of treating a subject having a cancer, comprising administering to the subject an effective amount of the nucleic acid molecule, cell, or pharmaceutical composition disclosed herein.

In one aspect, the invention provides a method of providing an anti-cancer immune response in a subject having a cancer, comprising administering to the subject an effective amount of the nucleic acid molecule, cell, or pharmaceutical composition disclosed herein.

In some embodiments, the disease associated with expression of a first antigen is a cancer. In some embodiments, the cancer exhibits heterogeneous expression of tumor antigens, e.g., wherein less than 90%, 80%, 70%, 60%, or 50% of cells in the cancer express the first tumor antigen, or wherein less than 90%, 80%, 70%, 60%, or 50% of cells in the cancer are responsive to the CAR-expressing cell. In some embodiments, the cancer is chosen from mesothelioma (e.g., malignant pleural mesothelioma); lung cancer (e.g., non-small cell lung cancer, small cell lung cancer, squamous cell lung cancer, or large cell lung cancer); pancreatic cancer (e.g., pancreatic ductal adenocarcinoma, or metastatic pancreatic ductal adenocarcinoma (PDA)); esophageal adenocarcinoma, ovarian cancer (e.g., serous epithelial ovarian cancer), breast cancer, colorectal cancer, bladder cancer or any combination thereof. In some embodiments, the cancer is a hematological cancer, e.g., a hematological cancer chosen from a leukemia or lymphoma, e.g., the cancer is chosen from chronic lymphocytic leukemia (CLL), mantle cell lymphoma (MCL), multiple myeloma, acute lymphoid leukemia (ALL), Hodgkin lymphoma, B-cell acute lymphoid leukemia (BALL), T-cell acute lymphoid leukemia (TALL), small lymphocytic leukemia (SLL), B cell prolymphocytic leukemia, blastic plasmacytoid dendritic cell neoplasm, Burkitt's lymphoma, diffuse large B cell lymphoma (DLBCL), DLBCL associated with chronic inflammation, chronic myeloid leukemia, myeloproliferative neoplasms, follicular lymphoma, pediatric follicular lymphoma, hairy cell leukemia, small cell- or a large cell-follicular lymphoma, malignant lymphoproliferative conditions, MALT lymphoma (extranodal marginal zone lymphoma of mucosa-associated lymphoid tissue), Marginal zone lymphoma, myelodysplasia, myelodysplastic syndrome, non-Hodgkin lymphoma, plasmablastic lymphoma, plasmacytoid dendritic cell neoplasm, Waldenstrom macroglobulinemia, splenic marginal zone lymphoma, splenic lymphoma/leukemia, splenic diffuse red pulp small B-cell lymphoma, hairy cell leukemia-variant, lymphoplasmacytic lymphoma, a heavy chain disease, plasma cell myeloma, solitary plasmocytoma of bone, extraosseous plasmocytoma, nodal marginal zone lymphoma, pediatric nodal marginal zone lymphoma, primary cutaneous follicle center lymphoma, lymphomatoid granulomatosis, primary mediastinal (thymic) large B-cell lymphoma, intravascular large B-cell lymphoma, ALK+ large B-cell lymphoma, large B-cell lymphoma arising in HHV8-associated multicentric Castleman disease, primary effusion lymphoma, B-cell lymphoma, acute myeloid leukemia (AML), or unclassifiable lymphoma.

In some embodiments, the method further comprises administering a third therapeutic agent. In some embodiments, the third therapeutic agent is administered prior to the administration of the RNA molecule, or the nucleic acid molecule encoding the RNA molecule. In some embodiments, the third therapeutic agent is administered subsequent to the administration of the RNA molecule, or the nucleic acid molecule encoding the RNA molecule. In some embodiments, the third therapeutic agent and the RNA molecule are administered simultaneously. In some embodiments, the third therapeutic agent and the nucleic acid molecule encoding the RNA molecule are administered simultaneously. In some embodiments, the third therapeutic agent is administered prior to the administration of the CAR-expressing cell. In some embodiments, the third therapeutic agent is administered subsequent to the administration of the CAR-expressing cell. In some embodiments, the third therapeutic agent and the CAR-expressing cell are administered simultaneously.

In some embodiments, the third therapeutic agent is an inhibitor of a pro-M2 macrophage molecule.

In some embodiments, the third therapeutic agent is chosen from an IL-13 inhibitor, an IL-4 inhibitor, an IL-13Rα1 inhibitor, an IL-4Rα inhibitor, an IL-10 inhibitor, a CSF-1 inhibitor, a CSF1R inhibitor, a TGF beta inhibitor, a JAK2 inhibitor, a cell surface molecule, an iron oxide, a small molecule inhibitor, a PI3K inhibitor, an HDAC inhibitor, an inhibitor of the glycolytic pathway, a mitochondria-targeted antioxidant, a clodronate liposome, or combinations thereof. In some embodiments, the third therapeutic agent is a CSF1R inhibitor. In some embodiments, the third therapeutic agent is an antibody molecule that binds to CSF1R. In some embodiments, the third therapeutic agent is a small molecule inhibitor of CSF1R. In some embodiments, the third therapeutic agent is BLZ945.

In some embodiments, the third therapeutic agent is a checkpoint modulator. In some embodiments, the third therapeutic agent is an anti-PD-1 antibody molecule, an anti-PD-L1 antibody molecule, an anti-CTLA-4 antibody molecule, an anti-TIM-3 antibody molecule, or an anti-LAG-3 antibody molecule. In some embodiments, the checkpoint modulator is administered after the administration of the RNA molecule, or the nucleic acid molecule encoding the RNA molecule. In some embodiments, the checkpoint modulator is administered prior to the administration of the RNA molecule, or the nucleic acid molecule encoding the RNA molecule. In some embodiments, the checkpoint modulator and the RNA molecule are administered simultaneously. In some embodiments, the checkpoint modulator and the nucleic acid molecule encoding the RNA molecule are administered simultaneously. In some embodiments, the checkpoint modulator is administered after the administration of the CAR-expressing cell. In some embodiments, the checkpoint modulator is administered prior to the administration of the CAR-expressing cell. In some embodiments, the checkpoint modulator and the CAR-expressing cell are administered simultaneously.

In some embodiments, the third therapeutic agent is a Flt3 ligand polypeptide.

In some embodiments, the administration of the RNA molecule enhances the activity of the third therapeutic agent in the subject, e.g., by at least 20, 40, 60, 80, 100, 500, or 1000%. In some embodiments, the administration of the CAR-expressing cell enhances the activity of the third therapeutic agent in the subject, e.g., by at least 20, 40, 60, 80, 100, 500, or 1000%. In some embodiments, the third therapeutic agent is a checkpoint modulator. In some embodiments, the third therapeutic agent is an anti-PD-1 antibody molecule, an anti-PD-L1 antibody molecule, an anti-CTLA-4 antibody molecule, an anti-TIM-3 antibody molecule, or an anti-LAG-3 antibody molecule. In some embodiments, the third therapeutic agent is an anti-PD-1 antibody molecule. In some embodiments, the third therapeutic agent is an anti-CTLA-4 antibody molecule. In some embodiments, the enhancement occurs in a subject having endogenous T cells. In some embodiments, the enhancement occurs through activation of endogenous T cells.

In one aspect, disclosed herein is a kit comprising (1) a first nucleic acid molecule (e.g., a first exogenous nucleic acid molecule) encoding a chimeric antigen receptor (CAR) molecule that binds to a first antigen, e.g., a first tumor antigen, and (2) a second nucleic acid molecule (e.g., a second exogenous nucleic acid molecule) comprising an RNA molecule (e.g., an exogenous RNA molecule) or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);
(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;
(iii) the RNA molecule activates macrophages, e.g., as measured by an increase in the expression of an activation marker in macrophages, e.g., as measured by an increase in the expression of CD80 in macrophages;
(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;
(v) the RNA molecule enhances immune infiltration into a tumor, e.g., infiltration of DCs or T cells into a tumor;
(vi) the RNA molecule reduces tumor growth;
(vii) the RNA molecule increases survival of the subject;
(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);
(ix) the RNA molecule does not bind or does not substantially bind to SRP9 and/or SRP14;
(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;
(xi) the RNA molecule is not polyinosinic:polycytidylic acid (poly I:C);
(xii) the RNA molecule does not have RNAi or antisense inhibition activity or the RNA molecule has minimal RNAi or antisense inhibition activity; or
(xiii) the RNA molecule has no more than 5%, 10%, 15%, 20%, 25%, 30%, 35%, or 40% sequence identity to a naturally-existing human gene.

In one aspect, disclosed herein is a method of making a cell, comprising:

(1) providing a cell, e.g., an immune cell, e.g., a T cell or NK cell, comprising a first nucleic acid molecule (e.g., a first exogenous nucleic acid molecule) encoding a chimeric antigen receptor (CAR) molecule that binds to a first antigen, e.g., a first tumor antigen, and
(2) contacting the cell ex vivo with a second nucleic acid molecule (e.g., a second exogenous nucleic acid molecule) comprising an RNA molecule (e.g., an exogenous RNA molecule) or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);
(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;
(iii) the RNA molecule activates macrophages, e.g., as measured by an increase in the expression of an activation marker in macrophages, e.g., as measured by an increase in the expression of CD80 in macrophages;
(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;
(v) the RNA molecule enhances immune infiltration into a tumor, e.g., infiltration of DCs or T cells into a tumor;
(vi) the RNA molecule reduces tumor growth;
(vii) the RNA molecule increases survival of the subject;
(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);
(ix) the RNA molecule does not bind or does not substantially bind to SRP9 and/or SRP14;
(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;
(xi) the RNA molecule is not polyinosinic:polycytidylic acid (poly I:C);
(xii) the RNA molecule does not have RNAi or antisense inhibition activity or the RNA molecule has minimal RNAi or antisense inhibition activity; or
(xiii) the RNA molecule has no more than 5%, 10%, 15%, 20%, 25%, 30%, 35%, or 40% sequence identity to a naturally-existing human gene.

In some embodiments, the first RNA sequence is at least 25, 30, 35, 40, 45, or 50 nucleotides in length. In some embodiments, the second RNA sequence is at least 25, 30, 35, 40, 45, or 50 nucleotides in length. In some embodiments, the first RNA sequence is at least 25, 30, 35, 40, 45, or 50 nucleotides in length; and the second RNA sequence is at least 25, 30, 35, 40, 45, or 50 nucleotides in length.

In some embodiments, the first RNA sequence and the second RNA sequence form a double-stranded RNA molecule. In some embodiments, the first RNA sequence and the second RNA sequence form a double-stranded RNA molecule of at least 20, 25, 30, 35, 40, 45, or 50 base pairs in length.

In some embodiments, the first RNA sequence is 100% complementary to the second RNA sequence.

In some embodiments, the first RNA sequence and the second RNA sequence are disposed on a single RNA molecule. In some embodiments, the first RNA sequence and the second RNA sequence form a hairpin structure. In some embodiments, the first RNA sequence and the second RNA sequence form a stem-loop structure. In some embodiments, the stem is of at least 20, 25, 30, 35, 40, 45, or 50 base pairs in length. In some embodiments, the loop is 2-10, 3-8, or 4-6 nucleotides in length.

In some embodiments, the first RNA sequence and the second RNA sequence are disposed on separate RNA molecules.

In some embodiments, the RNA molecule comprises one or more Alu domains. In some embodiments, the Alu domain comprises the amino acid sequence of SEQ ID NO: 4 or 6 (or a sequence at least about 85%, 90%, 95%, 99% or more identical thereto, and/or having one, two, three or more substitutions, insertions, deletions, or modifications). In some embodiments, the Alu domain comprises the amino acid sequence of SEQ ID NO: 4 or 6.

In some embodiments, the RNA molecule comprises the nucleotide sequence of SEQ ID NO: 2, 4, 6, 8, 10, or functional variant thereof. In some embodiments, the RNA molecule comprises a nucleotide sequence chosen from SEQ ID NO: 2, 4, 6, 8, or 10 (or a sequence at least about 85%, 90%, 95%, 99% or more identical thereto, and/or having one, two, three or more substitutions, insertions, deletions, or modifications). In some embodiments, the RNA molecule comprises a nucleotide sequence chosen from SEQ ID NO: 2, 4, 6, 8, or 10. In some embodiments, the RNA molecule comprises the nucleotide sequence of SEQ ID NO: 2. In some embodiments, the RNA molecule comprises the nucleotide sequence of SEQ ID NO: 4. In some embodiments, the RNA molecule comprises the nucleotide sequence of SEQ ID NO: 6. In some embodiments, the RNA molecule comprises the nucleotide sequence of SEQ ID NO: 8. In some embodiments, the RNA molecule comprises the nucleotide sequence of SEQ ID NO: 10.

In some embodiments, the nucleic acid molecule encoding the RNA molecule comprises the nucleotide sequence of SEQ ID NO: 1, 3, 5, 7, 9, or functional variant thereof. In some embodiments, the nucleic acid molecule encoding the RNA molecule comprises a nucleotide sequence chosen from SEQ ID NO: 1, 3, 5, 7, or 9 (or a sequence at least about 85%, 90%, 95%, 99% or more identical thereto, and/or having one, two, three or more substitutions, insertions, deletions, or modifications).

In some embodiments, the nucleic acid molecule encoding the RNA molecule comprises a nucleotide sequence chosen from SEQ ID NO: 1, 3, 5, 7, or 9. In some embodiments, the nucleic acid molecule encoding the RNA molecule comprises the nucleotide sequence of SEQ ID NO: 1. In some embodiments, the nucleic acid molecule encoding the RNA molecule comprises the nucleotide sequence of SEQ ID NO: 3. In some embodiments, the nucleic acid molecule encoding the RNA molecule comprises the nucleotide sequence of SEQ ID NO: 5. In some embodiments, the nucleic acid molecule encoding the RNA molecule comprises the nucleotide sequence of SEQ ID NO: 7. In some embodiments, the nucleic acid molecule encoding the RNA molecule comprises the nucleotide sequence of SEQ ID NO: 9.

In some embodiments, the RNA molecule comprises a 5'-triphosphate (5'ppp).

In some embodiments, the RNA molecule comprises at least one chemically modified nucleotide.

In some embodiments, the nucleic acid molecule encoding the RNA molecule is a DNA molecule.

In one aspect, provided herein is a method of evaluating or predicting a subject's responsiveness to a CAR-expressing cell therapy, comprising acquiring a value for the level or activity of an unshielded RNA molecule (e.g., an exogenous unshielded RNA molecule), wherein the RNA molecule comprises the nucleotide sequence of SEQ ID NO: 1, wherein the value comprises a ratio of the amount of the RNA molecule to the amount of a protein that binds to the RNA molecule, e.g., the amount of signal recognition particle 9 (SRP9) and/or signal recognition particle 14 (SRP14), wherein:

(i) an increase in the value, as compared to a reference value, is indicative or predictive of increased responsiveness of the subject to the CAR-expressing cell therapy; or (ii) a decrease in the value, as compared to a reference value, is indicative or predictive of decreased responsiveness of the subject to the CAR-expressing cell therapy.

In one aspect, provided herein is a method of treating a subject having a cancer, comprising:

responsive to an increased value for the level or activity of an unshielded RNA molecule (e.g., an exogenous unshielded RNA molecule) as compared to a reference value, wherein the RNA molecule comprises the nucleotide sequence of SEQ ID NO: 1, wherein the value comprises a ratio of the amount of the RNA molecule to the amount of a protein that binds to the RNA molecule, e.g., the amount of signal recognition particle 9 (SRP9) and/or signal recognition particle 14 (SRP14), administering a CAR-expressing cell therapy to the subject.

In some embodiments, the method further comprises, responsive to the increased value for the level or activity of the unshielded RNA molecule, administering to the subject an inhibitor of a pro-M2 macrophage molecule.

In one aspect, provided herein is a method of making a CAR-expressing cell (e.g., a CAR-expressing immune effector cell), comprising introducing any nucleic acid molecule disclosed herein into a cell (e.g., an immune effector cell), under a condition such that the CAR molecule is expressed.

In one aspect, provided herein a cell, e.g., an immune cell, e.g., a T cell or NK cell, comprising an RNA molecule (e.g., an exogenous RNA molecule), or a nucleic acid molecule (e.g., an exogenous nucleic acid molecule) encoding the RNA molecule. In some embodiments, the RNA molecule comprises a first RNA sequence (e.g., a first exogenous RNA sequence) and a second RNA sequence (e.g., a second exogenous RNA sequence), wherein the first RNA sequence is at least 80%, 85%, or 90% complementary to the second RNA sequence, wherein the first RNA sequence is at least 20 nucleotides in length and the second RNA sequence is at least 20 nucleotides in length, wherein the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);

(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;

(iii) the RNA molecule activates macrophages, e.g., as measured by an increase in the expression of an activation marker in macrophages, e.g., as measured by an increase in the expression of CD80 in macrophages;

(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;

(v) the RNA molecule enhances immune infiltration into a tumor, e.g., infiltration of DCs or T cells into a tumor;

(vi) the RNA molecule reduces tumor growth;

(vii) the RNA molecule increases survival of the subject;

(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);

(ix) the RNA molecule does not bind or does not substantially bind to SRP9 and/or SRP14;

(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;

(xi) the RNA molecule is not polyinosinic:polycytidylic acid (poly I:C);

(xii) the RNA molecule does not have RNAi or antisense inhibition activity or the RNA molecule has minimal RNAi or antisense inhibition activity; or (xiii) the RNA molecule has no more than 5%, 10%, 15%, 20%, 25%, 30%, 35%, or 40% sequence identity to a naturally-existing human gene.

In some embodiments, the cell further comprises a nucleic acid molecule encoding a synNotch polypeptide, wherein the synNotch polypeptide comprises:

(i) an extracellular domain comprising an antigen binding domain that is not naturally present in a Notch receptor polypeptide and that specifically binds to an antigen, e.g., a tumor antigen;

(ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site; and (iii) an intracellular domain comprising a transcriptional factor, wherein:

binding of the antigen binding domain to the antigen, e.g., the tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein:

the transcriptional factor, once released, activates the transcription of the nucleic acid molecule encoding the RNA molecule, optionally wherein:

(a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence, optionally wherein:

(1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In one aspect, provided herein is a method of making a cell comprising an RNA molecule (e.g., an exogenous RNA molecule), the method comprising contacting the cell with an RNA molecule of this invention.

In one aspect, provided herein is a method of making a cell comprising an RNA molecule (e.g., an exogenous RNA molecule), the method comprising introducing a nucleic acid molecule (e.g., an exogenous nucleic acid molecule) encoding the RNA molecule of this invention into the cell, e.g., by transduction or transfection. In some embodiments, the method further comprises introducing into the cell a nucleic acid molecule encoding a synNotch polypeptide, wherein the synNotch polypeptide comprises:

(i) an extracellular domain comprising an antigen binding domain that is not naturally present in a Notch receptor polypeptide and that specifically binds to an antigen, e.g., a tumor antigen;

(ii) a Notch receptor polypeptide comprising a ligand-inducible proteolytic cleavage site, e.g., a Notch regulatory region comprising a Lin 12-Notch repeat, an S2 proteolytic cleavage site, or a transmembrane domain comprising an S3 proteolytic cleavage site; and (iii) an intracellular domain comprising a transcriptional factor, wherein:

binding of the antigen binding domain to the antigen, e.g., the tumor antigen, induces cleavage at the ligand-inducible proteolytic cleavage site, e.g., induces cleavage at the S2 and/or S3 proteolytic cleavage site, thereby releasing the intracellular domain comprising the transcriptional factor, wherein:

the transcriptional factor, once released, activates the transcription of the nucleic acid molecule encoding the RNA molecule, optionally wherein:

(a) the transcriptional factor comprises a Gal4 DNA-binding domain and optionally a VP64 transcriptional activation domain, and (b) the N-terminus of the nucleic acid molecule encoding the RNA molecule is linked to a Gal4 upstream activation sequence, optionally wherein:

(1) the synNotch polypeptide comprises the amino acid sequence of SEQ ID NO: 17 (or a sequence at least about 85%, 90%, 95%, 99% or more identical thereto, and/or having one, two, three or more substitutions, insertions, deletions, or modifications), and (2) the Gal4 upstream activation sequence comprises the nucleotide sequence of SEQ ID NO: 18 (or a sequence at least about 85%, 90%, 95%, 99% or more identical thereto, and/or having one, two, three or more substitutions, insertions, deletions, or modifications).

In one aspect, this invention provides a pharmaceutical composition comprising a cell, e.g., an immune cell, e.g., a T cell or NK cell, comprising an RNA molecule (e.g., an exogenous RNA molecule) of this invention, or a nucleic acid molecule (e.g., an exogenous nucleic acid molecule) encoding the RNA molecule of this invention, and a pharmaceutically acceptable carrier, excipient, or stabilizer.

In one aspect, provided herein is a method of treating a subject having cancer comprising administering to the subject a cell, e.g., an immune cell, e.g., a T cell or NK cell, comprising an RNA molecule (e.g., an exogenous RNA molecule) of this invention, or a nucleic acid molecule (e.g., an exogenous nucleic acid molecule) encoding the RNA molecule of this invention.

In one aspect, provided herein is a method of increasing immune response in the subject in need thereof, the method comprising a cell, e.g., an immune cell, e.g., a T cell or NK cell, comprising an RNA molecule (e.g., an exogenous RNA molecule) of this invention, or a nucleic acid molecule (e.g., an exogenous nucleic acid molecule) encoding the RNA molecule of this invention.

BRIEF DESCRIPTION OF THE DRAWINGS

FIG. 1A is a graph comparing expression profiles of listed genes between the samples of the first quartile for the 7SL/SRP ratio and the samples of the fourth quartile for the 7SL/SRP ratio. FIGS. 1B and 1C are graphs showing the expression level of STAT1 and RAB7A, respectively, for the samples of the first quartile or the fourth quartile for the 7SL/SRP ratio. The 7SL/SRP ratio equals to RN7SL1 Reads/(SRP9+SRP14 Reads). The first quartile is the lowest quartile, and the fourth quartile is the highest quartile.

FIGS. 2A and 2B are graphs showing percent survival and tumor volume ($cm^3$), respectively, for each indicated time points.

FIG. 3A is a graph showing the percentage of macrophages in CD45+ cells for each group tested. FIG. 3B is a graph showing the percentage of MDSCs in CD45+ cells for each group tested. FIG. 3C is a panel of graphs showing flow cytometry plots for macrophages (upper panels) and MDSCs (lower panels) for the myc+4OHT treatment group ("7SL Unshielded") and the SRP+4OHT treatment group ("7SL Shielded"). FIG. 3D is a graph showing % CD206+ macrophages for the myc+4OHT+anti-CTLA-4 treatment group ("7SL Unshielded") and the myc+EtOH+anti-CTLA-4 treatment group ("7SL Unactivated"). FIGS. 3E and 3F: mice were implanted with the same tumors and subsequently treated with CSF1R inhibitor BLZ945. FIG. 3E is a graph showing percentage of M2 macrophages in CD45+ cells. FIG. 3F is a graph showing percentage of CD103+ DCs in CD45+ cells.

FIGS. 4A, 4C, and 4E are graphs showing tumor volume ($cm^3$) for each tested group. FIGS. 4B and 4D are graphs showing percent survival for each tested group. 7SL Unshielded=myc-ER+4OHT, 7SL Shielded=myc-ER/SRP+4OHT, 7SL Unactivated=myc-ER+EtOH. FIG. 4F: mice were implanted with tumors and treated with anti-CTLA4+/−BLZ945. Tumors were harvested and immune populations were assessed using an unbiased clustering of flow cytometry data. Activated CD4+ is emphasized.

In FIGS. 5A and 5B, tumor volume ($cm^3$) is plotted against tested time points for each treatment group.

FIG. 6A is a panel of histograms showing the expression of CD80 on macrophages, expression of CD80 on DCs, and expression of CD69 on bystander T cells. Blue corresponds to the treatment group with murine T cells transduced with h19BBz CAR. Red corresponds to the treatment group with murine T cells transduced with h19BBz-P2A-HP CAR. FIG. 6B is a panel of bar graphs showing expression of CD80 on mature DCs, expression of CD86 on mature DCs, percentage of M1 macrophages, and percentage of CD69+ T cells for the treatment group with murine T cells transduced with h19BBz CAR or h19BBz-P2A-HP CAR.

FIGS. 7A and 7B are graphs showing tumor volume ($cm^3$) and percent survival of mice receiving murine h19BBz CAR T cells or untreated T cells. FIG. 7C is a graph showing tumor volume ($cm^3$) of mice receiving murine h19BBz CAR T cells or murine h19BBz-P2A-HP CAR T cells. Tumors from the same mice were assessed for intratumoral immune activation. FIGS. 7D, 7E, and 7F are graphs showing % of dendritic cells in CD45+ cells, % CD206+M2 macrophages, and % CD69+ T cells, respectively.

FIGS. 8B and 8C are a pair of flow cytometry plots showing the level of GFP expression.

FIG. 9A is a pair of graphs showing CD69 measurement on T cells from Gal4-

HP or Gal4-Null cultures. FIG. 9B is a panel of graphs showing CD86 expression on circulating DCs.

FIGS. 10A and 10B: B16-hCD19 tumors were implanted into flanks of mice. 5 days later mice received an infusion of 5 million h19BBz CAR T cells. Tumor growth (FIG. 10A) and survival (FIG. 10B) were measured. FIGS. 10C and 10D: 1:1 hCD19:WT mixed tumors were injected into the flanks of mice. At day 13 tumors were measured (FIG. 10D) and mice were sacrificed. hCD19 expression was measured by flow cytometry in mice receiving h19BBz or left untreated (FIG. 10C).

FIG. 12C: the same experiment was done in mice deficient for the signaling adapter protein MyD88 and T cell activation was assessed.

FIG. 13A discloses SEQ ID NO: 10. FIG. 13B discloses SEQ ID NO: 851. FIG. 13C discloses SEQ ID NOs: 852-853, respectively, in order of appearance.

FIG. 14A is a schematic representation of the MEF system and the tumor/MEF co-implantation setup to assess the influence of unshielded RN7SL1 on immune infiltration and activation in vivo. FIGS. 14B, 14C, 14D, and 14E are graphs showing the relative frequency of indicated pro-inflammatory immune populations in tumor harvested 2 weeks post-injection.

FIG. 15A is a pair of graphs showing the relative frequency of indicated immunosuppressive populations in tumor harvested 2 weeks post-injection. FIG. 15B is a pair of representative flow cytometry plots showing the staining of TAMs and MDSCs after treatment with unshielded RN7SL1 or shielded RN7SL1.

FIG. 16A is a schematic showing that a CSF1R inhibitor blocks M2 polarization and may synergize with unshielded RN7SL1. FIG. 16B is a graph showing percent survival in mice treated with an anti-PD1 antibody and an anti-CTLA-4 antibody in the presence of unshielded or shielded RN7SL1. FIG. 16C is a graph showing percent survival in mice treated with an anti-PD1 antibody, an anti-CTLA-4 antibody, and a CSF1R inhibitor in the presence of unshielded or shielded RN7SL1.

FIG. 17A is a schematic showing experimental conditions. FIG. 17B is a graph showing fold change in DC frequency for the scramble RNA (Scr) control treated PBMCs as well as the 7SL treated PBMCs. FIG. 17C is a graph showing fold change in Batf3 MFI for the Scr or 7SL treated PBMCs. FIG. 17D is a graph showing fold change in CD86 MFI for the Scr or 7SL treated PBMCs.

FIG. 18A is a schematic showing experimental conditions. FIGS. 18B, 18C, and 18D are graphs showing % IFNγ+ cells, % TNFα+ cells, and % PD1+ cells, respectively, for the 7SL treated BMDCs, the Scramble RNA treated BMDCs, and the No BMDC sample. FIGS. 18E, 18F, and 18G are graphs showing TNFα expression in T cells cultured with 7SL stimulated BMDCs, Scramble RNA treated BMDCs, and No BMDC, respectively.

FIG. 19A is a schematic showing experimental conditions. FIG. 19B is a graph showing % of DCs as a percentage of CD45+ cells for the 7SL RNA group and the Scramble control RNA group. FIG. 19C is a graph showing % of CD69+ T cells for the 7SL RNA group and the Scramble control RNA group.

FIG. 20A is a schematic showing experimental conditions. FIG. 20B is a graph showing tumor volume of the 7SL and the Scramble treated groups, measured at Day 14. FIG. 20C is a graph showing percent survival for the mice treated with 7SL or Scramble control RNA with ICB. FIG. 20D is a graph showing percent survival for mice treated with 7SL RNA or No RNA with ICB.

FIG. 21A is a pair of schematics showing a construct expressing 19BBz CAR molecule (above) and a construct expressing 19BBz CAR molecule and 7SL RNA or scramble control RNA (below). FIG. 21B is a pair of flow cytometry plots showing CAR expression for the 19BBz group (left) and the 19BBz-7SL group (right). FIG. 21C is a graph showing percent survival of mice treated with various CAR T cells as indicated without addition of anti-CTLA4. FIG. 21D is a graph showing percent survival of mice treated with various CAR T cells as indicated with addition of anti-CTLA4. FIG. 21E is a graph showing tumor volume of the 19BBz-7SL+anti-CTLA4 group, the 19BBz-Scr+anti-CTLA4 group, the 19BBz+anti-CTLA4 group, the No T+anti-CTLA4 group, and the UTD+anti-CTLA4 group, measured at Day 14.

FIGS. 22A, 22B, and 22C are graphs showing dendritic cells as a percentage of CD45+ cells, % Ki67+ endogenous T cells, and M2 macrophages as a percentage of CD45+ cells, respectively, for the 19BBz-7SL group and the 19BBz-Scr group.

DESCRIPTION

Definitions

Figure 1A:
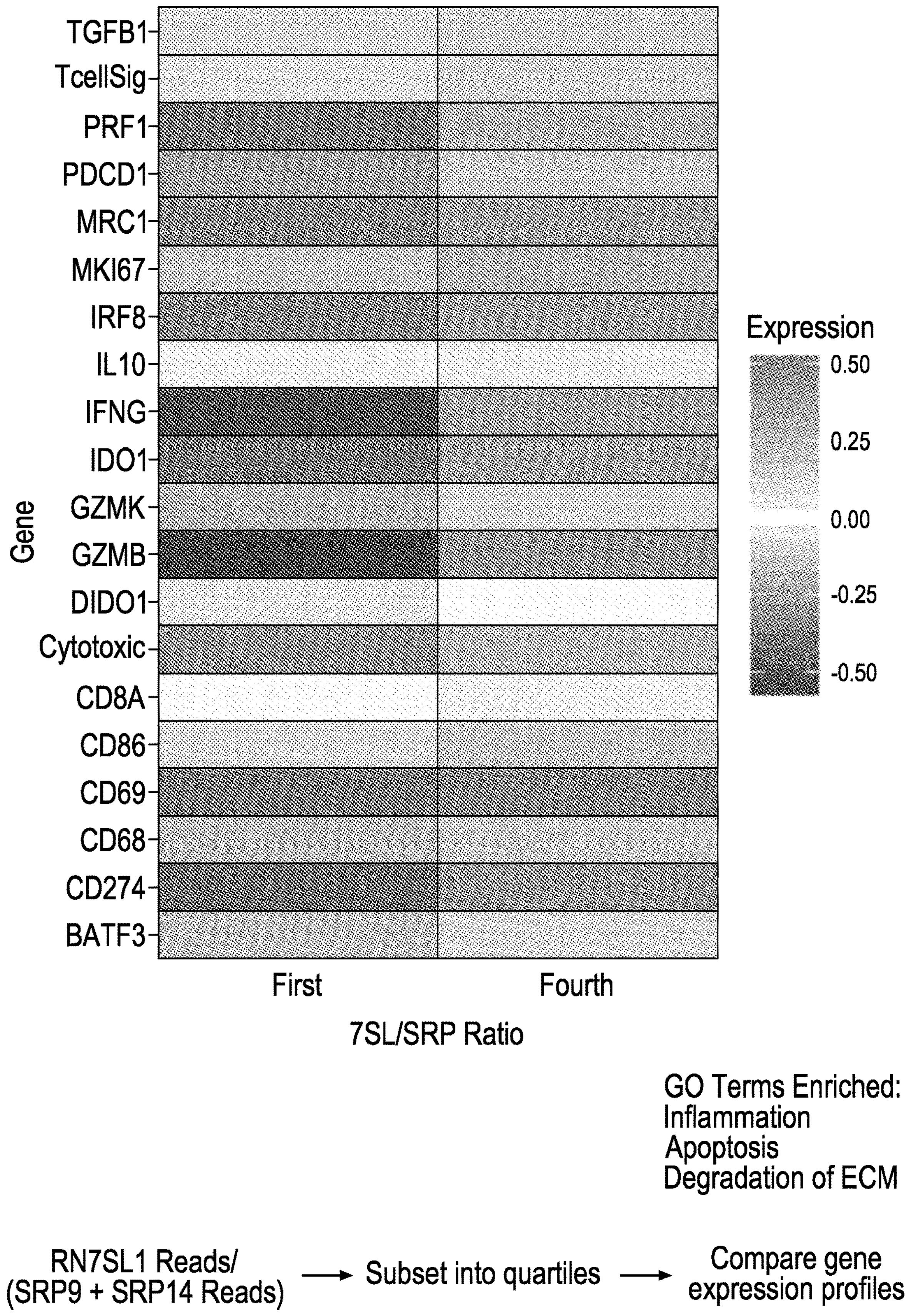
FIGS. 1A, 1B and 1C: Changes in immune infiltration are reflected in human tumors using TCGA data.

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "Chimeric Antigen Receptor" or alternatively a "CAR" refers to a recombinant polypeptide construct comprising at least an extracellular antigen binding domain, a transmembrane domain and a cytoplasmic signaling domain (also referred to herein as "an intracellular signaling domain") comprising a functional signaling domain derived from a stimulatory molecule as defined below. In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains, e.g., as provided in an RCAR as described herein.

In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from 41BB (i.e., CD137), CD27, ICOS, and/or CD28. In one aspect, the CAR comprises a chimeric fusion protein comprising an extracellular antigen recognition domain, a transmembrane domain and an intracellular signaling domain comprising a functional signaling domain derived from a stimulatory molecule. In one aspect, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one aspect, the CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In one aspect, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen recognition domain, wherein the leader sequence is optionally cleaved from the antigen recognition domain (e.g., an scFv) during cellular processing and localization of the CAR to the cellular membrane.

A CAR that comprises an antigen binding domain (e.g., an scFv, a single domain antibody, or TCR (e.g., a TCR alpha binding domain or TCR beta binding domain)) that targets a specific tumor marker X, wherein X can be a tumor marker as described herein, is also referred to as XCAR. For example, a CAR that comprises an antigen binding domain that targets CD19 is referred to as CD19CAR. The CAR can be expressed in any cell, e.g., an immune effector cell as described herein (e.g., a T cell or an NK cell).

The term "signaling domain" refers to the functional portion of a protein which acts by transmitting information within the cell to regulate cellular activity via defined signaling pathways by generating second messengers or functioning as effectors by responding to such messengers.

The term "antibody," as used herein, refers to a protein, or polypeptide sequence derived from an immunoglobulin molecule, which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an intact antibody, or recombinant variants thereof, and refers to the antigen binding domain, e.g., an antigenic determining variable region of an intact antibody, that is sufficient to confer recognition and specific binding of the antibody fragment to a target, such as an antigen. Examples of antibody fragments include, but are not limited to, Fab, Fab', F(ab')2, and Fv fragments, scFv antibody fragments, linear antibodies, single domain antibodies such as sdAb (either VL or VH), camelid VHH domains, and multi-specific molecules formed from antibody fragments such as a bivalent fragment comprising two or more, e.g., two, Fab fragments linked by a disulfide brudge at the hinge region, or two or more, e.g., two isolated CDR or other epitope binding fragments of an antibody linked. An antibody fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antibody fragments can also be grafted into scaffolds based on polypeptides such as a fibronectin type III (Fn3) (see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The terms "complementarity determining region" or "CDR," as used herein, refer to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273, 927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR composition of the invention comprising an antibody or antibody fragment thereof may exist in a variety of forms, for example, where the antigen binding domain is expressed as part of a polypeptide chain including, for example, a single domain antibody fragment (sdAb), a single chain antibody (scFv), or e.g., a humanized antibody (Harlow et at, 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises an scFv.

As used herein, the term "binding domain" or "antibody molecule" (also referred to herein as "anti-target binding domain") refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species.

The term "apheresis" as used herein refers to the art-recognized extracorporeal process by which the blood of a donor or patient is removed from the donor or patient and passed through an apparatus that separates out selected particular constituent(s) and returns the remainder to the circulation of the donor or patient, e.g., by retransfusion. Thus, in the context of "an apheresis sample" refers to a sample obtained using apheresis.

The term "combination" refers to either a fixed combination in one dosage unit form, or a combined administration where a compound of the present invention and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time. The term "pharmaceutical combination" as used herein means a product that results from the mixing or combining of more than one active ingredient and includes both fixed and non-fixed combinations of the active ingredients. The term "fixed combination" means that the active ingredients, e.g. a compound of the present invention and a combination partner, are both administered to a patient simultaneously in the form of a single entity or dosage. The term "non-fixed combination" means that the active ingredients, e.g. a compound of the present invention and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more active ingredients.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. Preferred cancers treated by the methods described herein include multiple myeloma, Hodgkin's lymphoma or non-Hodgkin's lymphoma.

The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of an antigen, e.g., a tumor antigen" includes, but is not limited to, a disease associated with a cell which expresses the antigen (e.g., wild-type or mutant antigen) or condition associated with a cell which expresses the antigen (e.g., wild-type or mutant antigen) including, e.g., proliferative diseases such as a cancer or malignancy or a precancerous condition such as a myelodysplasia, a myelodysplastic syndrome or a preleukemia; or a noncancer related indication associated with a cell which expresses the antigen (e.g., wild-type or mutant antigen). For the avoidance of doubt, a disease associated with expression of the antigen may include a condition associated with a cell which does not presently express the antigen, e.g., because expression of the antigen has been downregulated, e.g., due to treatment with a molecule targeting the antigen, but which at one time expressed the antigen. In some embodiments, the disease associated with expression of an antigen, e.g., a tumor antigen is a cancer (e.g., a solid cancer or a hematological cancer), a viral infection (e.g., HIV, a fungal infection, e.g., *C. neoformans*), an autoimmune disease (e.g. rheumatoid arthritis, system lupus erythematosus (SLE or lupus), pemphigus vulgaris, and Sjogren's syndrome; inflammatory bowel disease, ulcerative colitis; transplant-related allospecific immunity disorders related to mucosal immunity; and unwanted immune responses towards biologics (e.g., Factor VIII) where humoral immunity is important).

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative substitutions are ones in which the amino acid residue is replaced with an amino acid residue having a similar side chain Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as downregulation of TGF-β, and/or reorganization of cytoskeletal structures, and the like.

The term "stimulatory molecule," refers to a molecule expressed by a T cell that provides the primary cytoplasmic signaling sequence(s) that regulate primary activation of the TCR complex in a stimulatory way for at least some aspect of the T cell signaling pathway. In some embodiments, the ITAM-containing domain within the CAR recapitulates the signaling of the primary TCR independently of endogenous TCR complexes. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CD5, CD22, CD79a, CD79b, CD278 (also known as "ICOS"), FcεRI and CD66d, DAP10 and DAP12. In a specific CAR of the invention, the intracellular signaling domain in any one or more CARS of the invention comprises an intracellular signaling sequence, e.g., a primary signaling sequence of CD3-zeta. The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. In embodiments, the intracellular signal domain transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD278 (also known as "ICOS"), FcεRI, CD66d, DAP10 and DAP12.

The term "zeta" or alternatively "zeta chain", "CD3-zeta" or "TCR-zeta" refers to CD247. Swiss-Prot accession number P20963 provides exemplary human CD3 zeta amino acid sequences. A "zeta stimulatory domain" or alternatively a "CD3-zeta stimulatory domain" or a "TCR-zeta stimulatory domain" refers to a stimulatory domain of CD3-zeta or a variant thereof (e.g., a molecule having mutations, e.g., point mutations, fragments, insertions, or deletions). In one embodiment, the cytoplasmic domain of zeta comprises residues 52 through 164 of GenBank Acc. No. BAG36664.1 or a variant thereof (e.g., a molecule having mutations, e.g., point mutations, fragments, insertions, or deletions). In one embodiment, the "zeta stimulatory domain" or a "CD3-zeta stimulatory domain" is the sequence provided as SEQ ID NO: 641 or 643 or a variant thereof (e.g., a molecule having mutations, e.g., point mutations, fragments, insertions, or deletions).

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an MHC class I molecule, TNF receptor proteins, Immunoglobulin-like proteins, cytokine receptors, integrins, signaling lymphocytic activation molecules (SLAM proteins), activating NK cell receptors, BTLA, Toll ligand receptor, OX40, CD2, CD7, CD27, CD28, CD30, CD40, CD5, ICAM-1, LFA-1 (CD11a/CD18), 4-1BB (CD137), B7-H3, CD5, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to the intracellular portion of a costimulatory molecule.

The intracellular signaling domain can comprise the entire intracellular portion, or the entire native intracellular signaling domain, of the molecule from which it is derived, or a functional fragment thereof.

The term "4-1BB" refers to CD137 or Tumor necrosis factor receptor superfamily member 9. Swiss-Prot accession number P20963 provides exemplary human 4-1BB amino acid sequences. A "4-1BB costimulatory domain" refers to a costimulatory domain of 4-1BB, or a variant thereof (e.g., a molecule having mutations, e.g., point mutations, fragments, insertions, or deletions). In one embodiment, the "4-1BB costimulatory domain" is the sequence provided as SEQ ID NO: 637 or a variant thereof (e.g., a molecule having mutations, e.g., point mutations, fragments, insertions, or deletions).

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence. In some embodiments, expression comprises translation of an mRNA introduced into a cell.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions, e.g., conservative substitutions), alleles, orthologs, SNPs, and complementary sequences as well as the sequence explicitly indicated. Specifically, degenerate codon substitutions, e.g., conservative substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically a protein, carbohydrate or lipid) that is expressed on the surface of a cancer cell, either entirely or as a fragment (e.g., MHC/ peptide), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "tumor-supporting antigen" or "cancer-supporting antigen" interchangeably refer to a molecule (typically a protein, carbohydrate or lipid) that is expressed on the surface of a cell that is, itself, not cancerous, but supports the cancer cells, e.g., by promoting their growth or survival e.g., resistance to immune cells. Exemplary cells of this type include stromal cells and myeloid-derived suppressor cells (MDSCs). The tumor-supporting antigen itself need not play a role in supporting the tumor cells so long as the antigen is present on a cell that supports cancer cells.

The term "flexible polypeptide linker" or "linker" as used in the context of an scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n, where n is a positive integer equal to or greater than 1. For example, n=1, n=2, n=3. n=4, n=5 and n=6, n=7, n=8, n=9 and n=10 (SEQ ID NO: 28). In one embodiment, the flexible polypeptide linkers include, but are not limited to, (Gly4 Ser)4 (SEQ ID NO: 29) or (Gly4 Ser)3 (SEQ ID NO: 30). In another embodiment, the linkers include multiple repeats of (Gly2Ser), (GlySer) or (Gly3Ser) (SEQ ID NO: 31). Also included within the scope of the invention are linkers described in WO2012/138475, incorporated herein by reference.

As used herein, a 5' cap (also termed an RNA cap, an RNA 7-methylguanosine cap or an RNA m7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 32), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms “treat”, “treatment” and “treating”-refer to the inhibition of the progression of a proliferative disorder, either physically by, e.g., stabilization of a discernible symptom, physiologically by, e.g., stabilization of a physical parameter, or both. In other embodiments the terms “treat”, “treatment” and “treating” refer to the reduction or stabilization of tumor size or cancerous cell count.

The term “signal transduction pathway” refers to the biochemical relationship between a variety of signal transduction molecules that play a role in the transmission of a signal from one portion of a cell to another portion of a cell. The phrase “cell surface receptor” includes molecules and complexes of molecules capable of receiving a signal and transmitting signal across the membrane of a cell.

The term “subject” is intended to include living organisms in which an immune response can be elicited (e.g., mammals, human).

The term, a “substantially purified” cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term “therapeutic” as used herein means a treatment. A therapeutic effect is obtained by reduction, suppression, remission, or eradication of a disease state.

The term “prophylaxis” as used herein means the prevention of or protective treatment for a disease or disease state.

In the context of the present invention, “tumor antigen” or “hyperproliferative disorder antigen” or “antigen associated with a hyperproliferative disorder” refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer (e.g., castrate-resistant or therapy-resistant prostate cancer, or metastatic prostate cancer), ovarian cancer, pancreatic cancer, and the like, or a plasma cell proliferative disorder, e.g., asymptomatic myeloma (smoldering multiple myeloma or indolent myeloma), monoclonal gammapathy of undetermined significance (MGUS), Waldenstrom’s macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

The term “transfected” or “transformed” or “transduced” refers to a process by which exogenous nucleic acid is transferred or introduced into the host cell. A “transfected” or “transformed” or “transduced” cell is one which has been transfected, transformed or transduced with exogenous nucleic acid. The cell includes the primary subject cell and its progeny.

The term “specifically binds,” refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

“Regulatable chimeric antigen receptor (RCAR),” as used herein, refers to a set of polypeptides, typically two in the simplest embodiments, which when in an immune effector cell, provides the cell with specificity for a target cell, typically a cancer cell, and with intracellular signal generation. In some embodiments, an RCAR comprises at least an extracellular antigen binding domain, a transmembrane domain and a cytoplasmic signaling domain (also referred to herein as “an intracellular signaling domain”) comprising a functional signaling domain derived from a stimulatory molecule and/or costimulatory molecule as defined herein in the context of a CAR molecule. In some embodiments, the set of polypeptides in the RCAR are not contiguous with each other, e.g., are in different polypeptide chains. In some embodiments, the RCAR includes a dimerization switch that, upon the presence of a dimerization molecule, can couple the polypeptides to one another, e.g., can couple an antigen binding domain to an intracellular signaling domain. In some embodiments, the RCAR is expressed in a cell (e.g., an immune effector cell) as described herein, e.g., an RCAR-expressing cell (also referred to herein as “RCARX cell”). In an embodiment the RCARX cell is a T cell, and is referred to as a RCART cell. In an embodiment the RCARX cell is an NK cell, and is referred to as a RCARN cell. The RCAR can provide the RCAR-expressing cell with specificity for a target cell, typically a cancer cell, and with regulatable intracellular signal generation or proliferation, which can optimize an immune effector property of the RCAR-expressing cell. In embodiments, an RCAR cell relies at least in part, on an antigen binding domain to provide specificity to a target cell that comprises the antigen bound by the antigen binding domain.

“Membrane anchor” or “membrane tethering domain”, as that term is used herein, refers to a polypeptide or moiety, e.g., a myristoyl group, sufficient to anchor an extracellular or intracellular domain to the plasma membrane.

“Switch domain,” as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjuction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive immune effector cells, e.g., T cells or NK cells, and/or an increase in the number of PD-1 negative immune effector cells, e.g., T cells or NK cells, or an increase in the ratio of PD-1 negative immune effector cells (e.g., T cells or NK cells)/PD-1 positive immune effector cells (e.g., T cells or NK cells).

In an embodiment, the low, immune enhancing, dose of mTOR inhibitor results in an increase in the number of naive T cells. In an embodiment, the low, immune enhancing, dose of mTOR inhibitor results in one or more of the following:

an increase in the expression of one or more of the following markers: CD62Lhigh, CD127high, CD27+, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased CD62Lhigh, increased CD127high, increased CD27+, decreased KLRG1, and increased BCL2;

wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" or a "relapse" as used herein refers to the reappearance of a disease (e.g., cancer) or the signs and symptoms of a disease such as cancer after a period of improvement or responsiveness, e.g., after prior treatment of a therapy, e.g., cancer therapy. For example, the period of responsiveness may involve the level of cancer cells falling below a certain threshold, e.g., below 20%, 15%, 10%, 5%, 4%, 3%, 2%, or 1%. The reappearance may involve the level of cancer cells rising above a certain threshold, e.g., above 20%, 15%, 10%, 5%, 4%, 3%, 2%, or 1%.

In one aspect, a "responder" of a therapy can be a subject having complete response, very good partial response, or partial response after receiving the therapy. In one aspect, a "non-responder" of a therapy can be a subject having minor response, stable disease, or progressive disease after receiving the therapy. In some embodiments, the subject has multiple myeloma and the response of the subject to a multiple myeloma therapy is determined based on IMWG 2016 criteria, e.g., as disclosed in Kumar, et al., Lancet Oncol. 17, e328-346 (2016), hereby incorporated herein by reference in its entirety.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

A "gene editing system" as the term is used herein, refers to a system, e.g., one or more molecules, that direct and effect an alteration, e.g., a deletion, of one or more nucleic acids at or near a site of genomic DNA targeted by said system. Gene editing systems are known in the art, and are described more fully below.

Various aspects of the compositions and methods herein are described in further detail below. Additional definitions are set out throughout the specification.

DETAILED DESCRIPTION

The present invention provides, at least in part, a method of treating a subject, e.g., a subject having a cancer, comprising administering to the subject an effective number of a cell (e.g., a population of cells) that expresses a CAR molecule, optionally in combination with an RNA molecule (e.g., an exogenous RNA molecule) or a nucleic acid molecule (e.g., an exogenous nucleic acid molecule) encoding the RNA molecule.

Stimulatory RNA Molecules

In one aspect, the invention includes an RNA molecule (e.g., an exogenous RNA molecule), e.g., a stimulatory RNA molecule, e.g., an immune stimulatory RNA molecule. In some embodiments, the RNA molecule activates a pattern recognition receptor (PRR), e.g., retinoic acid-inducible gene I (RIG-I). In some embodiments, the RNA molecule activates dendritic cells (DCs), macrophages, and/or T cells.

In some embodiments, the RNA molecule comprises a first RNA sequence (e.g., a first exogenous RNA sequence) and a second RNA sequence (e.g., a second exogenous RNA sequence). In some embodiments, the first RNA sequence is at least 80%, 85%, or 90% complementary to the second RNA sequence. In some embodiments, the first RNA sequence is at least 20 nucleotides in length and the second RNA sequence is at least 20 nucleotides in length. In some embodiments, the RNA molecule increases an immune activity. In some embodiments, the RNA molecule has one or more (e.g., 1, 2, 3, 4, 5, 6, 7, 8, 9, 10, 11, 12, or all) of the following properties:

(i) the RNA molecule activates a pattern recognition receptor (PRR), e.g., retinoic acid-inducible gene I (RIG-I);
(ii) the RNA molecule activates dendritic cells (DCs), e.g., as measured by an increase in the expression of an activation marker in DCs, e.g., as measured by an increase in the expression of CD80, CD86 or Basic leucine zipper transcriptional factor ATF-like 3 (Batf3) in DCs, or as measured by the ability of the DCs to prime CD8+ T cells;
(iii) the RNA molecule activates macrophages, e.g., as measured by an increase in the expression of an activation marker in macrophages, e.g., as measured by an increase in the expression of CD80 in macrophages;
(iv) the RNA molecule activates T cells, e.g., as measured by an increase in the expression of an activation marker in T cells, an increase in T cell expansion, or an increase in cytokine production by T cells, e.g., as measured by an increase in the expression of CD69 or PD-1 in T cells, or as measured by IFNγ or TNFα production by T cells;
(v) the RNA molecule enhances immune infiltration into a tumor, e.g., infiltration of DCs or T cells into a tumor;
(vi) the RNA molecule reduces tumor growth;
(vii) the RNA molecule increases survival of the subject;
(viii) the RNA molecule enhances the subject's responsiveness to the CAR-expressing cells or a checkpoint modulator (e.g., an anti-PD-1 antibody molecule, an anti-PD-L1 antibody molecule, an anti-CTLA-4 antibody molecule, an anti-TIM-3 antibody molecule, or an anti-LAG-3 antibody molecule);
(ix) the RNA molecule does not bind or does not substantially bind to SRP9 and/or SRP14;
(x) the RNA molecule is a functional variant of a naturally-existing RN7SL1 RNA molecule, wherein the RNA molecule retains all or part of the immunogenic property of the naturally-existing RN7SL1 RNA molecule, optionally wherein the RNA molecule shows reduced binding to SRP9 and/or SRP14 compared with the naturally-existing RN7SL1 RNA molecule, e.g., the RNA molecule does not bind to or does not substantially bind to SRP9 and/or SRP14;
(xi) the RNA molecule is not polyinosinic:polycytidylic acid (poly I:C);
(xii) the RNA molecule does not have RNAi or antisense inhibition activity or the RNA molecule has minimal RNAi or antisense inhibition activity; or
(xiii) the RNA molecule has no more than 5%, 10%, 15%, 20%, 25%, 30%, 35%, or 40% sequence identity to a naturally-existing human gene.

In some embodiments, the first RNA sequence is at least 25, 30, 35, 40, 45, or 50 nucleotides in length. In some embodiments, the second RNA sequence is at least 25, 30, 35, 40, 45, or 50 nucleotides in length. In some embodiments, the first RNA sequence is at least 25, 30, 35, 40, 45, or 50 nucleotides in length; and the second RNA sequence is at least 25, 30, 35, 40, 45, or 50 nucleotides in length.

In some embodiments, the first RNA sequence and the second RNA sequence form a double-stranded RNA molecule. In some embodiments, the first RNA sequence and the second RNA sequence form a double-stranded RNA molecule of at least 20, 25, 30, 35, 40, 45, or 50 base pairs in length.

In some embodiments, the first RNA sequence is 100% complementary to the second RNA sequence.

In some embodiments, the first RNA sequence and the second RNA sequence are disposed on a single RNA molecule. In some embodiments, the first RNA sequence and the second RNA sequence form a hairpin structure. In some embodiments, the first RNA sequence and the second RNA sequence form a stem-loop structure. In some embodiments, the stem is of at least 20, 25, 30, 35, 40, 45, or 50 base pairs in length. In some embodiments, the loop is 2-10, 3-8, or 4-6 nucleotides in length.

In some embodiments, the first RNA sequence and the second RNA sequence are disposed on separate RNA molecules.

In some embodiments, the RNA molecule comprises one or more Alu domains. In some embodiments, the Alu domain comprises the amino acid sequence of SEQ ID NO: 4 or 6 (or a sequence at least about 85%, 90%, 95%, 99% or more identical thereto, and/or having one, two, three or more substitutions, insertions, deletions, or modifications). In some embodiments, the Alu domain comprises the amino acid sequence of SEQ ID NO: 4 or 6.

In some embodiments, the RNA molecule comprises the nucleotide sequence of SEQ ID NO: 2, 4, 6, 8, 10, or functional variant thereof. In some embodiments, the RNA molecule comprises a nucleotide sequence chosen from SEQ ID NO: 2, 4, 6, 8, or 10 (or a sequence at least about 85%, 90%, 95%, 99% or more identical thereto, and/or having one, two, three or more substitutions, insertions, deletions, or modifications). In some embodiments, the RNA molecule comprises a nucleotide sequence chosen from SEQ ID NO: 2, 4, 6, 8, or 10. In some embodiments, the RNA molecule comprises the nucleotide sequence of SEQ ID NO: 2. In some embodiments, the RNA molecule comprises the nucleotide sequence of SEQ ID NO: 4. In some embodiments, the RNA molecule comprises the nucleotide sequence of SEQ ID NO: 6. In some embodiments, the RNA molecule comprises the nucleotide sequence of SEQ ID NO: 8. In some embodiments, the RNA molecule comprises the nucleotide sequence of SEQ ID NO: 10.

In some embodiments, the nucleic acid molecule encoding the RNA molecule comprises the nucleotide sequence of SEQ ID NO: 1, 3, 5, 7, 9, or functional variant thereof. In some embodiments, the nucleic acid molecule encoding the RNA molecule comprises the nucleotide sequence of SEQ ID NO: 1, 3, 5, 7, or 9 (or a sequence at least about 85%, 90%, 95%, 99% or more identical thereto, and/or having one, two, three or more substitutions, insertions, deletions, or modifications).

In some embodiments, the nucleic acid molecule encoding the RNA molecule comprises the nucleotide sequence of SEQ ID NO: 1, 3, 5, 7, or 9. In some embodiments, the nucleic acid molecule encoding the RNA molecule comprises the nucleotide sequence of SEQ ID NO: 1. In some embodiments, the nucleic acid molecule encoding the RNA molecule comprises the nucleotide sequence of SEQ ID NO: 3. In some embodiments, the nucleic acid molecule encoding the RNA molecule comprises the nucleotide sequence of SEQ ID NO: 5. In some embodiments, the nucleic acid molecule encoding the RNA molecule comprises the nucleotide sequence of SEQ ID NO: 7. In some embodiments, the nucleic acid molecule encoding the RNA molecule comprises the nucleotide sequence of SEQ ID NO: 9.

In some embodiments, the RNA molecule is an RN7SL1 RNA molecule, e.g., a human RN7SL1 RNA molecule, or functional variant thereof. In some embodiments, the RNA molecule is an RN7SL1 RNA molecule, e.g., a human RN7SL1 RNA molecule. In some embodiments, the RNA molecule comprises the nucleotide sequence of SEQ ID NO: 2 (or a sequence at least about 85%, 90%, 95%, 99% or more identical thereto, and/or having one, two, three or more substitutions, insertions, deletions, or modifications). In some embodiments, the RNA molecule comprises an Alu domain, or functional variant thereof. In some embodiments, the RNA molecule comprises an Alu domain comprising the nucleotide sequence of SEQ ID NO: 4 or 6 (or a sequence at least about 85%, 90%, 95%, 99% or more identical thereto, and/or having one, two, three or more substitutions, insertions, deletions, or modifications). In some embodiments, the RNA molecule is an Alu-Ya5 RNA molecule, or functional variant thereof. In some embodiments, the RNA molecule is an Alu-Ya5 RNA molecule. In some embodiments, the RNA molecule comprises the nucleotide sequence of SEQ ID NO: 8 (or a sequence at least about 85%, 90%, 95%, 99% or more identical thereto, and/or having one, two, three or more substitutions, insertions, deletions, or modifications). In some embodiments, the RNA molecule is an RNA molecule (e.g., an exogenous RNA molecule) that retains the immune stimulatory activity of an RN7SL1 RNA molecule or an Alu-Ya5 RNA molecule, but does not bind or does not substantially bind to SRP9 and/or SRP14. In some embodiments, the binding of the RNA molecule to SRP9 and/or SRP14 is no more than 5, 10, 15, 20, 25, 30, or 35% of the binding of an RN7SL1 RNA molecule (e.g., an RNA molecule (e.g., an exogenous RNA molecule) comprising the nucleotide sequence of SEQ ID NO: 2) to SRP9 and/or SRP14. In some embodiments, the RNA molecule comprises the nucleotide sequence of SEQ ID NO: 10 (or a sequence at least about 85%, 90%, 95%, 99% or more identical thereto, and/or having one, two, three or more substitutions, insertions, deletions, or modifications). Exemplary sequences of RNA molecules and DNA molecules encoding the RNA molecules are disclosed in Table 1.

TABLE 1

Exemplary sequences of stimulatory RNAs and others

| SEQ ID NO | Comment | Sequence |
|---|---|---|
| SEQ ID NO: 1 | RN7SL1 | GCCGGGCGCGGTGGCGCGTGCCTGTAGTCCCAGCTACTCGGGAGG<br>CTGAGGCTGGAGGATCGCTTGAGTCCAGGAGTTCTGGGCTGTAGT<br>GCGCTATGCCGATCGGGTGTCCGCACTAAGTTCGGCATCAATATG<br>GTGACCTCCCGGGAGCGGGGGACCACCAGGTTGCCTAAGGAGGG<br>GTGAACCGGCCCAGGTCGGAAACGGAGCAGGTCAAAACTCCCGTG<br>CTGATCAGTAGTGGGATCGCGCCTGTGAATAGCCACTGCACTCCA<br>GCCTGGGCAACATAGCGAGACCCCGTCTCT |
| SEQ ID NO: 2 | RN7SL1 RNA | GCCGGGCGCGGUGGCGCGUGCCUGUAGUCCCAGCUACUCGGGAG<br>GCUGAGGCUGGAGGAUCGCUUGAGUCCAGGAGUUCUGGGCUGU<br>AGUGCGCUAUGCCGAUCGGGUGUCCGCACUAAGUUCGGCAUCAA<br>UAUGGUGACCUCCCGGGAGCGGGGGACCACCAGGUUGCCUAAGG<br>AGGGGUGAACCGGCCCAGGUCGGAAACGGAGCAGGUCAAAACUC<br>CCGUGCUGAUCAGUAGUGGGAUCGCGCCUGUGAAUAGCCACUGC<br>ACUCCAGCCUGGGCAACAUAGCGAGACCCCGUCUCU |
| SEQ ID NO: 3 | RN7SL1 fragment #1 | GCCGGGCGCGGTGGCGCGTGCCTGTAGTCCCAGCTACTCGGGAGG<br>CTGAGGCTGGAGGATCGCTTGAGTC |
| SEQ ID NO: 4 | RN7SL1 fragment #1 RNA | GCCGGGCGCGGUGGCGCGUGCCUGUAGUCCCAGCUACUCGGGAG<br>GCUGAGGCUGGAGGAUCGCUUGAGUC |
| SEQ ID NO: 5 | RN7SL1 fragment #2 | CAACATAGCGAGACCCCGTCTCT |
| SEQ ID NO: 6 | RN7SL1 fragment #2 RNA | CAACAUAGCGAGACCCCGUCUCU |
| SEQ ID NO: 7 | Alu-Ya5 followed by a poly-A tail | GCGGCCGCTCTAGAACTAGTGGATCCCCCCCCCCCGCTCCCCAAAT<br>GACGTAACTGTCCCTGCAGCTTCTAGATAGCTTTTCGCAGCGTCTC<br>CGACCGGCCGGGCCGGGCGCGGTGGCTCACGCCTGTAATCCCAGC<br>ACTTTGGGAGGCCGAGGCGGGCGGATCACGAGGTCAGGAGATCG<br>AGACCATCCCGGCTAAAACGGTGAAACCCCGTCTCTACTAAAAAT<br>ACAAAAAATTAGCCGGGCGTAGTGGCGGGCGCCTGTAGTCCCAGC |

TABLE 1-continued

| Exemplary sequences of stimulatory RNAs and others | | |
|---|---|---|
| SEQ ID NO | Comment | Sequence |
| | | TACTTGGGAGGCTGAGGCAGGAGAATGGCGTGAACCCGGGAGGC<br>GGAGCTTGCAGTGAGCCGAGATCCCGCCACTGCACTCCAGCCTGG<br>GCGACAGAGCGAgaCGTCTCAAATCCCCTCAAAAAAAAAAAAAAA<br>AAAAAAAAAAAAAAAAAAAAAAAAAAAAAACATGGACTCAAAG<br>TTTCAGCATCGCGTCTCTTTTGCCGAATTCGATATCAAGCTTATCG<br>ATACC |
| SEQ ID NO: 8 RNA | Alu-Ya5 followed by a poly-A tail | GCGGCCGCUCUAGAACUAGUGGAUCCCCCCCCCCCGCUCCCCAA<br>AUGACGUAACUGUCCCUGCAGCUUCUAGAUAGCUUUUCGCAGCG<br>UCUCCGACCGGCCGGGCCGGGCGCGGUGGCUCACGCCUGUAAUC<br>CCAGCACUUUGGGAGGCCGAGGCGGGCGGAUCACGAGGUCAGGA<br>GAUCGAGACCAUCCCGGCUAAAACGGUGAAACCCCGUCUCUACU<br>AAAAAUACAAAAAAUUAGCCGGGCGUAGUGGCGGGCGCCUGUA<br>GUCCCAGCUACUUGGGAGGCUGAGGCAGGAGAAUGGCGUGAACC<br>CGGGAGGCGGAGCUUGCAGUGAGCCGAGAUCCCGCCACUGCACU<br>CCAGCCUGGGCGACAGAGCGAGACGUCUCAAAUCCCCUCAAAAA<br>AAAAAAAAAAAAAAAAAAAAAAAAAAAAAAAAAAAAAAACAUG<br>GGACUCAAAGUUUCAGCAUCGCGUCUCUUUUGCCGAAUUCGAUA<br>UCAAGCUUAUCGAUACC |
| SEQ ID NO: 9 | Hairpin | AGTCAGTCAGTCAGTCAGTCAGTCCCCGGGGACTGACTGACTGAC<br>TGACTGAC |
| SEQ ID NO: 10 | Hairpin RNA | AGUCAGUCAGUCAGUCAGUCAGUCCCCGGGGACUGACUGACUGA<br>CUGACUGAC |
| SEQ ID NO: 11 | GFP nucleotide sequence | ATGAGTAAAGGAGAAGAACTTTTCACTGGAGTTGTCCCAATTCTT<br>GTTGAATTAGATGGTGATGTTAATGGGCACAAATTTTCTGTCAGTG<br>GAGAGGGTGAAGGTGATGCAACATACGGAAAACTTACCCTTAAAT<br>TTATTTGCACTACTGGAAAACTACCTGTTCCATGGCCAACACTTGT<br>CACTACTTTCGGTTATGGTGTTCAATGCTTTGCGAGATACCCAGAT<br>CATATGAAACAGCATGACTTTTTCAAGAGTGCCATGCCTGAAGGT<br>TATGTACAGGAAAGAACTATATTTTTCAAAGATGACGGGAACTAC<br>AAGACACGTGCTGAAGTCAAGTTTGAAGGTGATACCCTTGTTAAT<br>AGAATCGAGTTAAAAGGTATTGATTTTAAAGAAGATGGAAACATT<br>CTTGGACACAAATTGGAATACAACTATAACTCACACAATGTATAC<br>ATCATGGCAGACAAACAAAAGAATGGAATCAAAGTTAACTTCAAA<br>ATTAGACACAACATTGAAGATGGAAGCGTTCAACTAGCAGACCAT<br>TATCAACAAAATACTCCAATTGGCGATGGCCCTGTCCTTTTACCAG<br>ACAACCATTACCTGTCCACACAATCTGCCCTTTCGAAAGATCCCAA<br>CGAAAAGAGAGACCACATGGTCCTTCTTGAGTTTGTAACAGCTGC<br>TGGGATTACACATGGCATGGATGAACTATACAAATAA |
| SEQ ID NO: 12 | GFP amino acid sequence | MSKGEELFTGVVPILVELDGDVNGHKFSVSGEGEGDATYGKLTLKFI<br>CTTGKLPVPWPTLVTTFGYGVQCFARYPDHMKQHDFFKSAMPEGYV<br>QERTIFFKDDGNYKTRAEVKFEGDTLVNRIELKGIDFKEDGNILGHKL<br>EYNYNSHNVYIMADKQKNGIKVNFKIRHNIEDGSVQLADHYQQNTPI<br>GDGPVLLPDNHYLSTQSALSKDPNEKRDHMVLLEFVTAAGITHGMD<br>ELYK |
| SEQ ID NO: 13 | pGK promoter | AGCTTATGGTGCCCCAACCCCAACGCGGAAAAGGTTCCGTCGGGA<br>CCCAAACGCGTCCCTGCGCCGACGAGACCCGCACCAAGGCCCTTT<br>GCGTCGCCGCGGCTGGGACCCAGAGCGTGTAAGAAGTGCAGGCA<br>AGCGTCGCAGTGGGCCTAGAAGCGGCGATGGGAACACCCGGGGG<br>GCCGCTGCGAAGGACGAGGCGGGGATTCAGCCCTTCCAAGGAACG<br>CCAAGCGCCGCACGGCCTGCACTATTTGCCTTCGGCGTGCAGAGT<br>GATCATGGGAGCGTCTGCCTGTCGCGGTCCCTCGTTACCGTCGCGC<br>GGCTGGCGCTACCCGACACCGGTTATCGCCGACGAGTCGTCCCGC<br>GCGGCTCTCGTCGCCGGCCCTTCCCCGCCACGCCCTCCGCCCCACA<br>CCCCGCCATCACACCCGGGACAAGGACGGGCGCGCCACAAGGCGT<br>AAGACGTTCGGAGGCCTCGCGTGCAGCCGTCAGCCGAGGGAGCAA<br>CTGGCTTAGTGGCTGGAGAGAGGGGT |
| SEQ ID NO: 14 | CTL019 scFv nucleotide sequence | GACATCCAGATGACACAGACTACATCCTCCCTGTCTGCCTCTCTGG<br>GAGACAGAGTCACCATCAGTTGCAGGGCAAGTCAGGACATTAGTA<br>AATATTTAAATTGGTATCAGCAGAAACCAGATGGAACTGTTAAAC<br>TCCTGATCTACCATACATCAAGATTACACTCAGGAGTCCCATCAAG<br>GTTCAGTGGCAGTGGGTCTGGAACAGATTATTCTCTCACCATTAGC<br>AACCTGGAGCAAGAAGATATTGCCACTTACTTTTGCCAACAGGGT<br>AATACGCTTCCGTACACGTTCGGAGGGGGGACCAAGCTGGAGATC<br>ACAGGTGGCGGTGGCTCGGGCGGTGGTGGGTCGGGTGGCGGCGG<br>ATCTGAGGTGAAACTGCAGGAGTCAGGACCTGGCCTGGTGGCGCC |

TABLE 1-continued

Exemplary sequences of stimulatory RNAs and others

| SEQ ID NO | Comment | Sequence |
|---|---|---|
| | | CTCACAGAGCCTGTCCGTCACATGCACTGTCTCAGGGGTCTCATTA<br>CCCGACTATGGTGTAAGCTGGATTCGCCAGCCTCCACGAAAGGGT<br>CTGGAGTGGCTGGGAGTAATATGGGGTAGTGAAACCACATACTAT<br>AATTCAGCTCTCAAATCCAGACTGACCATCATCAAGGACAACTCC<br>AAGAGCCAAGTTTTCTTAAAAATGAACAGTCTGCAAACTGATGAC<br>ACAGCCATTTACTACTGTGCCAAACATTATTACTACGGTGGTAGCT<br>ATGCTATGGACTACTGGGGCCAAGGAACCTCAGTCACCGTCTCCT<br>CA |
| SEQ ID NO: 15 | CTL019 scFv amino acid sequence | DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPYT<br>FGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTS<br>VTVSS |
| SEQ ID NO: 16 | synNotch TM + IC nucleotide sequence | GATTACTGGGGGCAAGGCACGTCAGTGACAGTGAGTTCAATCCTG<br>GACTACAGCTTCACAGGTGGCGCTGGGCGCGACATTCCCCCACCG<br>CAGATTGAGGAGGCCTGTGAGCTGCCTGAGTGCCAGGTGGATGCA<br>GGCAATAAGGTCTGCAACCTGCAGTGTAATAATCACGCATGTGGC<br>TGGGATGGTGGCGACTGCTCCCTCAACTTCAATGACCCCTGGAAG<br>AACTGCACGCAGTCTCTACAGTGCTGGAAGTATTTTAGCGACGGC<br>CACTGTGACAGCCAGTGCAACTCGGCCGGCTGCCTCTTTGATGGCT<br>TCGACTGCCAGCTCACCGAGGGACAGTGCAACCCCCTGTATGACC<br>AGTACTGCAAGGACCACTTCAGTGATGGCCACTGCGACCAGGGCT<br>GTAACAGTGCCGAATGTGAGTGGGATGGCCTAGACTGTGCTGAGO<br>ATGTACCCGAGCGGCTGGCAGCCGGCACCCTGGTGCTGGTGGTGC<br>TGCTTCCACCCGACCAGCTACGGAACAACTCCTTCCACTTTCTGCG<br>GGAGCTCAGCCACGTGCTGCACACCAACGTGGTCTTCAAGCGTGA<br>TGCGCAAGGCCAGCAGATGATCTTCCCGTACTATGGCCACGAGGA<br>AGAGCTGCGCAAGCACCCAATCAAGCGCTCTACAGTGGGTTGGGC<br>CACCTCTTCACTGCTTCCTGGTACCAGTGGTGGGCGCCAGCGCAGG<br>GAGCTGGACCCCATGGACATCCGTGGCTCCATTGTCTACCTGGAG<br>ATCGACAACCGGCAATGTGTGCAGTCATCCTCGCAGTGCTTCCAG<br>AGTGCCACCGATGTGGCTGCCTTCCTAGGTGCTCTTGCGTCACTTG<br>GCAGCCTCAATATTCCTTACAAGATTGAGGCCGTGAAGAGTGAGC<br>CGGTGGAGCCTCCGCTGCCCTCGCAGCTGCACCTCATGTACGTGGC<br>AGCGGCCGCCTTCGTGCTCCTGTTCTTTGTGGGCTGTGGGGTGCTG<br>CTGTCCCGCAAGCGCCGGCGGATGAAGCTGCTGAGCAGCATCGAG<br>CAGGCCTGTGACATCTGCCGGCTGAAGAAACTGAAGTGCAGCAAA<br>GAAAAGCCCAAGTGCGCCAAGTGCCTGAAGAACAACTGGGAGTC<br>CCGGTACAGCCCCAAGACCAAGAGAAGCCCCCTGACCAGAGCCCA<br>CCTGACCGAGGTGGAAAGCCGGCTGGAAAGACTGGAACAGCTGTT<br>TCTGCTGATCTTCCCACGCGAGGACCTGGACATGATCCTGAAGAT<br>GGACAGCCTGCAGGACATCAAGGCCCTGCTGACCGGCCTGTTCGT<br>GCAGGACAACGTGAACAAGGACGCCGTGACCGACAGACTGGCCA<br>GCGTGGAAACCGACATGCCCCTGACCCTGCGGCAGCACAGAATCA<br>GCGCCACCAGCAGCAGCGAGGAAAGCAGCAACAAGGGCCAGCGG<br>CAGCTGACAGTGTCTGCTGCTGCAGGCGGAAGCGGAGGCTCTGGC<br>GGATCTGATGCCCTGGACGACTTCGACCTGGATATGCTGGGCAGC<br>GACGCCCTGGATGATTTTGATCTGGACATGCTGGGATCTGACGCTC<br>TGGACGATTTCGATCTCGACATGTTGGGATCAGATGCACTGGATG<br>ACTTTGACCTGGACATGCTCGGATCATGAG |
| SEQ ID NO: 17 | synNotch TM + IC amino acid sequence | DYWGQGTSVTVSSILDYSFTGGAGRDIPPPQIEEACELPECQVDAGNK<br>VCNLQCNNHACGWDGGDCSLNFNDPWKNCTQSLQCWKYFSDGHC<br>DSQCNSAGCLFDGFDCQLTEGQCNPLYDQYCKDHFSDGHCDQGCNS<br>AECEWDGLDCAEHVPERLAAGTLVLVVLLPPDQLRNNSFHFLRELSH<br>VLHTNVVFKRDAQGQQMIFPYYGHEEELRKHPIKRSTVGWATSSLLP<br>GTSGGRQRRELDPMDIRGSIVYLEIDNRQCVQSSSQCFQSATDVAAFL<br>GALASLGSLNIPYKIEAVKSEPVEPPLPSQLHLMYVAAAAFVLLFFVG<br>CGVLLSRKRRRMKLLSSIEQACDICRLKKLKCSKEKPKCAKCLKNNW<br>ECRYSPKTKRSPLTRAHLTEVESRLERLEQLFLLIFPREDLDMILKMDS<br>LQDIKALLTGLFVQDNVNKDAVTDRLASVETDMPLTLRQHRISATSS<br>SEESSNKGQRQLTVSAAAGGSGGSGGSDALDDFDLDMLGSDALDDF<br>DLDMLGSDALDDFDLDMLGSDALDDFDLDMLGS |
| SEQ ID NO: 18 | Gal4-Response Element | GGAGCACTGTCCTCCGAACGTCGGAGCACTGTCCTCCGAACGTCG<br>GAGCACTGTCCTCCGAACGTCGGAGCACTGTCCTCCGAACGGAGC<br>ATGTCCTCCGAACGTCGGAGCACTGTCCTCCGAA |

TABLE 1-continued

Exemplary sequences of stimulatory RNAs and others

| SEQ ID NO | Comment | Sequence |
|---|---|---|
| SEQ ID NO: 19 | Gal4-Alu response element | GGAGCACTGTCCTCCGAACGTCGGAGCACTGTCCTCCGAACGTCG<br>GAGCACTGTCCTCCGAACGTCGGAGCACTGTCCTCCGAACGGAGC<br>ATGTCCTCCGAACGTCGGAGCACTGTCCTCCGAATCTAGACCGCG<br>GGCGGCCGCTCTAGAACTAGTGGATCCCCCCCCCCGCTCCCCAA<br>ATGACGTAACTGTCCCTGCAGCTTCTAGATAGCTTTTCGCAGCGTC<br>TCCGACCGGCCGGGCCGGGCGCGGTGGCTCACGCCTGTAATCCCA<br>GCACTTTGGGAGGCCGAGGCGGGCGGATCACGAGGTCAGGAGAT<br>CGAGACCATCCCGGCTAAAACGGTGAAACCCCGTCTCTACTAAAA<br>ATACAAAAAATTAGCCGGGCGTAGTGGCGGGCGCCTGTAGTCCCA<br>GCTACTTGGGAGGCTGAGGCAGGAGAATGGCGTGAACCCGGGAG<br>GCGGAGCTTGCAGTGAGCCGAGATCCCGCCACTGCACTCCAGCCT<br>GGGCGACAGAGCGAgaCGTCTCAAATCCCCTCAAAAAAAAAAAAA<br>AAAAAAAAAAAAAAAAAAAAAAAAAAAAAAACATGGGACTCAA<br>AGTTTCAGCATCGCGTCTCTTTTGCCGAATTCGATATCAAGCTTAT<br>CGATACC |
| SEQ ID NO: 27 | Gal4-HP response element | GGAGCACTGTCCTCCGAACGTCGGAGCACTGTCCTCCGAACGTCG<br>GAGCACTGTCCTCCGAACGTCGGAGCACTGTCCTCCGAACGGAGC<br>ATGTCCTCCGAACGTCGGAGCACTGTCCTCCGAATCTAGAAGTCA<br>GTCAGTCAGTCAGTCAGTCCCCGGGGACTGACTGACTGACTGACT<br>GACGTCGACT |
| SEQ ID NO: 20 | anti-CD19 synNotch receptor nucleotide sequence | GACATCCAGATGACACAGACTACATCCTCCCTGTCTGCCTCTCTGG<br>GAGACAGAGTCACCATCAGTTGCAGGGCAAGTCAGGACATTAGTA<br>AATATTTAAATTGGTATCAGCAGAAACCAGATGGAACTGTTAAAC<br>TCCTGATCTACCATACATCAAGATTACACTCAGGAGTCCCATCAAG<br>GTTCAGTGGCAGTGGGTCTGGAACAGATTATTCTCTCACCATTAGC<br>AACCTGGAGCAAGAAGATATTGCCACTTACTTTTGCCAACAGGGT<br>AATACGCTTCCGTACACGTTCGGAGGGGGGACCAAGCTGGAGATC<br>ACAGGTGGCGGTGGCTCGGGCGGTGGTGGGTCGGGTGGCGGCGG<br>ATCTGAGGTGAAACTGCAGGAGTCAGGACCTGGCCTGGTGGCGCC<br>CTCACAGAGCCTGTCCGTCACATGCACTGTCTCAGGGGTCTCATTA<br>CCCGACTATGGTGTAAGCTGGATTCGCCAGCCTCCACGAAAGGGT<br>CTGGAGTGGCTGGGAGTAATATGGGGTAGTGAAACCACATACTAT<br>AATTCAGCTCTCAAATCCAGACTGACCATCATCAAGGACAACTCC<br>AAGAGCCAAGTTTTCTTAAAAATGAACAGTCTGCAAACTGATGAC<br>ACAGCCATTTACTACTGTGCCAAACATTATTACTACGGTGGTAGCT<br>ATGCTATGGACTACTGGGGCCAAGGAACCTCAGTCACCGTCTCCT<br>CACCGCGGGATTACTGGGGGCAAGGCACGTCAGTGACAGTGAGTT<br>CAATCCTGGACTACAGCTTCACAGGTGGCGCTGGGCGCGACATTC<br>CCCCACCGCAGATTGAGGAGGCCTGTGAGCTGCCTGAGTGCCAGG<br>TGGATGCAGGCAATAAGGTCTGCAACCTGCAGTGTAATAATCACG<br>CATGTGGCTGGGATGGTGGCGACTGCTCCCTCAACTTCAATGACCC<br>CTGGAAGAACTGCACGCAGTCTCTACAGTGCTGGAAGTATTTTAG<br>CGACGGCCACTGTGACAGCCAGTGCAACTCGGCCGGCTGCCTCTT<br>TGATGGCTTCGACTGCCAGCTCACCGAGGGACAGTGCAACCCCCT<br>GTATGACCAGTACTGCAAGGACCACTTCAGTGATGGCCACTGCGA<br>CCAGGGCTGTAACAGTGCCGAATGTGAGTGGGATGGCCTAGACTG<br>TGCTGAGCATGTACCCGAGCGGCTGGCAGCCGGCACCCTGGTGCT<br>GGTGGTGCTGCTTCCACCCGACCAGCTACGGAACAACTCCTTCCAC<br>TTTCTGCGGGAGCTCAGCCACGTGCTGCACACCAACGTGGTCTTCA<br>AGCGTGATGCGCAAGGCCAGCAGATGATCTTCCCGTACTATGGCC<br>ACGAGGAAGAGCTGCGCAAGCACCCAATCAAGCGCTCTACAGTGG<br>GTTGGGCCACCTCTTCACTGCTTCCTGGTACCAGTGGTGGGCGCCA<br>GCGCAGGGAGCTGGACCCCATGGACATCCGTGGCTCCATTGTCTA<br>CCTGGAGATCGACAACCGGCAATGTGTGCAGTCATCCTCGCAGTG<br>CTTCCAGAGTGCCACCGATGTGGCTGCCTTCCTAGGTGCTCTTGCG<br>TCACTTGGCAGCCTCAATATTCCTTACAAGATTGAGGCCGTGAAG<br>AGTGAGCCGGTGGAGCCTCCGCTGCCCTCGCAGCTGCACCTCATG<br>TACGTGGCAGCGGCCGCCTTCGTGCTCCTGTTCTTTGTGGGCTGTG<br>GGGTGCTGCTGTCCCGCAAGCGCCGGCGGATGAAGCTGCTGAGCA<br>GCATCGAGCAGGCCTGTGACATCTGCCGGCTGAAGAAACTGAAGT<br>GCAGCAAAGAAAAGCCCAAGTGCGCCAAGTGCCTGAAGAACAAC<br>TGGGAGTGCCGGTACAGCCCCAAGACCAAGAGAAGCCCCCTGACC<br>AGAGCCCACCTGACCGAGGTGGAAAGCCGGCTGGAAAGACTGGA<br>ACAGCTGTTTCTGCTGATCTTCCCACGCGAGGACCTGGACATGATC<br>CTGAAGATGGACAGCCTGCAGGACATCAAGGCCCTGCTGACCGGC<br>CTGTTCGTGCAGGACAACGTGAACAAGGACGCCGTGACCGACAGA<br>CTGGCCAGCGTGGAAACCGACATGCCCCTGACCCTGCGGCAGCAC<br>AGAATCAGCGCCACCAGCAGCAGCGAGGAAAGCAGCAACAAGGG<br>CCAGCGGCAGCTGACAGTGTCTGCTGCTGCAGGCGGAAGCGGAGG<br>CTCTGGCGGATCTGATGCCCTGGACGACTTCGACCTGGATATGCTG<br>GGCAGCGACGCCCTGGATGATTTTGATCTGGACATGCTGGGATCT<br>GACGCTCTGGACGATTTCGATCTCGACATGTTGGGATCAGATGCA<br>CTGGATGACTTTGACCTGGACATGCTCGGATCATGAG |

TABLE 1-continued

| Exemplary sequences of stimulatory RNAs and others | | |
|---|---|---|
| SEQ ID NO | Comment | Sequence |
| SEQ ID NO: 21 | Anti-CD19 synNotch receptor amino acid sequence | DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPYT<br>FGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTS<br>VTVSSPRDYWGQGTSVTVSSILDYSFTGGAGRDIPPPQIEEACELPECQ<br>VDAGNKVCNLQCNNHACGWDGGDCSLNFNDPWKNCTQSLQCWKY<br>FSDGHCDSQCNSAGCLFDGFDCQLTEGQCNPLYDQYCKDHFSDGHC<br>DQGCNSAECEWDGLDCAEHVPERLAAGTLVLVVLLPPDQLRNNSFH<br>FLRELSHVLHTNVVFKRDAQGQQMIFPYYGHEEELRKHPIKRSTVGW<br>ATSSLLPGTSGGRQRRELDPMDIRGSIVYLEIDNRQCVQSSSQCFQSAT<br>DVAAFLGALASLGSLNIPYKIEAVKSEPVEPPLPSQLHLMYVAAAAFV<br>LLFFVGCGVLLSRKRRRMKLLSSIEQACDICRLKKLKCSKEKPKCAKC<br>LKNNWECRYSPKTKRSPLTRAHLTEVESRLERLEQLFLLIFPREDLDM<br>ILKMDSLQDIKALLTGLFVQDNVNKDAVTDRLASVETDMPLTLRQHR<br>ISATSSSEESSNKGQRQLTVSAAAGGSGGSGGSDALDDFDLDMLGSD<br>ALDDFDLDMLGSDALDDFDLDMLGSDALDDFDLDMLGS |
| SEQ ID NO: 22 | 19BBz P2A HP nucleotide sequence | AGTCAGTCAGTCAGTCAGTCAGTCCCCGGGGACTGACTGACTGAC<br>TGACTGACGTCGACTGGAAGCGGAGCTACTAACTTCAGCCTGCTG<br>AAGCAGGCTGGAGACGTGGAGGAGAACCCTGGACCTCCTAGGAT<br>GGCCTTACCAGTGACCGCCTTGCTCCTGCCGCTGGCCTTGCTGCTC<br>CACGCCGCCAGGCCGGACATCCAGATGACACAGACTACATCCTCC<br>CTGTCTGCCTCTCTGGGAGACAGAGTCACCATCAGTTGCAGGGCA<br>AGTCAGGACATTAGTAAATATTTAAATTGGTATCAGCAGAAACCA<br>GATGGAACTGTTAAACTCCTGATCTACCATACATCAAGATTACACT<br>CAGGAGTCCCATCAAGGTTCAGTGGCAGTGGGTCTGGAACAGATT<br>ATTCTCTCACCATTAGCAACCTGGAGCAAGAAGATATTGCCACTTA<br>CTTTTGCCAACAGGGTAATACGCTTCCGTACACGTTCGGAGGGGG<br>GACCAAGCTGGAGATCACAGGTGGCGGTGGCTCGGGCGGTGGTGG<br>GTCGGGTGGCGGCGGATCTGAGGTGAAACTGCAGGAGTCAGGACC<br>TGGCCTGGTGGCGCCCTCACAGAGCCTGTCCGTCACATGCACTGTC<br>TCAGGGGTCTCATTACCCGACTATGGTGTAAGCTGGATTCGCCAGC<br>CTCCACGAAAGGGTCTGGAGTGGCTGGGAGTAATATGGGGTAGTG<br>AAACCACATACTATAATTCAGCTCTCAAATCCAGACTGACCATCAT<br>CAAGGACAACTCCAAGAGCCAAGTTTTCTTAAAAATGAACAGTCT<br>GCAAACTGATGACACAGCCATTTACTACTGTGCCAAACATTATTAC<br>TACGGTGGTAGCTATGCTATGGACTACTGGGGCCAAGGAACCTCA<br>GTCACCGTCTCCTCAACCACGACGCCAGCGCCGCGACCACCAACA<br>CCGGCGCCCACCATCGCGTCGCAGCCCCTGTCCCTGCGCCCAGAG<br>GCGTGCCGGCCAGCGGCGGGGGGCGCAGTGCACACGAGGGGGCT<br>GGACTTCGCCTGTGATATCTACATCTGGGCGCCCTTGGCCGGGACT<br>TGTGGGGTCCTTCTCCTGTCACTGGTTATCACCCTTTACTGCAAAC<br>GGGGCAGAAAGAAACTCCTGTATATATTCAAACAACCATTTATGA<br>GACCAGTACAAACTACTCAAGAGGAAGATGGCTGTAGCTGCCGAT<br>TTCCAGAAGAAGAAGAAGGAGGATGTGAACTGAGAGTGAAGTTC<br>AGCAGGAGCGCAGACGCCCCCGCGTACAAGCAGGGCCAGAACCA<br>GCTCTATAACGAGCTCAATCTAGGACGAAGAGAGGAGTACGATGT<br>TTTGGACAAGAGACGTGGCCGGGACCCTGAGATGGGGGGAAAGC<br>CGAGAAGGAAGAACCCTCAGGAAGGCCTGTACAATGAACTGCAG<br>AAAGATAAGATGGCGGAGGCCTACAGTGAGATTGGGATGAAAGG<br>CGAGCGCCGGAGGGGCAAGGGGCACGATGGCCTTTACCAGGGTCT<br>CAGTACAGCCACCAAGGACACCTACGACGCCCTTCACATGCAGGC<br>CCTGCCCCCTCGC |
| SEQ ID NO: 23 | P2A nucleotide sequence | GGAAGCGGAGCTACTAACTTCAGCCTGCTGAAGCAGGCTGGAGAC<br>GTGGAGGAGAACCCTGGACCT |
| SEQ ID NO: 24 | P2A amino acid sequence | GSGATNFSLLKQAGDVEENPGP |
| SEQ ID NO: 25 | CTL019 full-length nucleotide sequence | GACATCCAGATGACACAGACTACATCCTCCCTGTCTGCCTCTCTGG<br>GAGACAGAGTCACCATCAGTTGCAGGGCAAGTCAGGACATTAGTA<br>AATATTTAAATTGGTATCAGCAGAAACCAGATGGAACTGTTAAAC<br>TCCTGATCTACCATACATCAAGATTACACTCAGGAGTCCCATCAAG<br>GTTCAGTGGCAGTGGGTCTGGAACAGATTATTCTCTCACCATTAGC<br>AACCTGGAGCAAGAAGATATTGCCACTTACTTTTGCCAACAGGGT<br>AATACGCTTCCGTACACGTTCGGAGGGGGGACCAAGCTGGAGATC<br>ACAGGTGGCGGTGGCTCGGGCGGTGGTGGGTCGGGTGGCGGCGG<br>ATCTGAGGTGAAACTGCAGGAGTCAGGACCTGGCCTGGTGGCGCC |

TABLE 1-continued

| Exemplary sequences of stimulatory RNAs and others | | |
|---|---|---|
| SEQ ID NO | Comment | Sequence |
| | | CTCACAGAGCCTGTCCGTCACATGCACTGTCTCAGGGGTCTCATTA<br>CCCGACTATGGTGTAAGCTGGATTCGCCAGCCTCCACGAAAGGGT<br>CTGGAGTGGCTGGGAGTAATATGGGGTAGTGAAACCACATACTAT<br>AATTCAGCTCTCAAATCCAGACTGACCATCATCAAGGACAACTCC<br>AAGAGCCAAGTTTTCTTAAAAATGAACAGTCTGCAAACTGATGAC<br>ACAGCCATTTACTACTGTGCCAAACATTATTACTACGGTGGTAGCT<br>ATGCTATGGACTACTGGGGCCAAGGAACCTCAGTCACCGTCTCCT<br>CAACCACGACGCCAGCGCCGCGACCACCAACACCGGCGCCCACCA<br>TCGCGTCGCAGCCCCTGTCCCTGCGCCCAGAGGCGTGCCGGCCAG<br>CGGCGGGGGGCGCAGTGCACACGAGGGGGCTGGACTTCGCCTGTG<br>ATATCTACATCTGGGCGCCCTTGGCCGGGACTTGTGGGGTCCTTCT<br>CCTGTCACTGGTTATCACCCTTTACTGCAAACGGGGCAGAAAGAA<br>ACTCCTGTATATATTCAAACAACCATTTATGAGACCAGTACAAACT<br>ACTCAAGAGGAAGATGGCTGTAGCTGCCGATTTCCAGAAGAAGAA<br>GAAGGAGGATGTGAACTGAGAGTGAAGTTCAGCAGGAGCGCAGA<br>CGCCCCCGCGTACAAGCAGGGCCAGAACCAGCTCTATAACGAGCT<br>CAATCTAGGACGAAGAGAGGAGTACGATGTTTTGGACAAGAGAC<br>GTGGCCGGGACCCTGAGATGGGGGGAAAGCCGAGAAGGAAGAAC<br>CCTCAGGAAGGCCTGTACAATGAACTGCAGAAAGATAAGATGGCG<br>GAGGCCTACAGTGAGATTGGGATGAAAGGCGAGCGCCGGAGGGG<br>CAAGGGGCACGATGGCCTTTACCAGGGTCTCAGTACAGCCACCAA<br>GGACACCTACGACGCCCTTCACATGCAGGCCCTGCCCCCTCGC |
| SEQ ID NO: 26 | CTL019 full-length amino acid sequence | DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPYT<br>FGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTS<br>VTVSSTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQ<br>EEDGCSCRFPEEEEGGCELRVKFSRSADAPAYKQGQNQLYNELNLGR<br>REEYDVLDKRRGRDPEMGGKPRRKNPQEGLYNELQKDKMAEAYSEI<br>GMKGERRRGKGHDGLYQGLSTATKDTYDALHMQALPPR |
| SEQ ID NO: 849 | 19BBz-U6-7SL Uni-directional | tgaaagaccccacctgtaggtttggcaagctagcttaagtaacgccattttgcaaggcatggaaaatacataact<br>gagaatagagaagttcagatcaaggttaggaacagagagacagcagaatatgggccaaacaggatatctgtg<br>gtaagcagttcctgccccggctcagggccaagaacagatggtccccagatgcggtcccgccctcagcagttt<br>ctagagaaccatcagatgtttccagggtgccccaaggacctgaaaatgaccctgtgccttatttgaactaacca<br>atcagttcgcttctcgcttctgttcgcgcgcttctgctccccgagctcaataaaagagcccacaacccctcactc<br>ggcgcgccagtcctccgatagactgcgtcgcccgggtacccgtattcccaataaagcctcttgctgtttgcatc<br>cgaatcgtggactcgctgatccttgggagggtctcctcagattgattgactgcccacctcgggggtctttcatttg<br>gaggttccaccgagatttggagacccctgcctagggaccaccgacccccccgccgggaggtaagctggcc<br>agcggtcgtttcgtgtctgtctctgtctttgtgcgtgtttgtgccggcatctaatgtttgcgcctgcgtctgtactagt<br>tagctaactagctctgtatctggcggacccgtggtggaactgacgagttcggaacacccggccgcaaccctg<br>ggagacgtcccagggacttcgggggccgtttttgtggcccgacctgagtccaaaaatcccgatcgttttggact<br>ctttggtgcacccccccttagaggagggatatgtggttctggtaggagacgagaacctaaaacagttcccgcctc<br>cgtctgaatttttgctttcggtttgggaccgaagccgcgccgcgcgtcttgtctgctgcagcatcgttctgtgttgt<br>ctctgtctgactgtgtttctgtatttgtctgagaatatgggcccgggctagcctgttaccactcccttaagtttgacc<br>ttaggtcactggaaagatgtcgagcggatcgctcacaaccagtcggtagatgtcaagaagagacgttgggtta<br>ccttctgctctgcagaatggccaacctttaacgtcggatggccgcgagacggcacctttaaccgagacctcatc<br>acccaggttaagatcaaggtcttttcacctggcccgcatggacacccagaccaggtcccctacatcgtgacct<br>gggaagccttggcttttgacccccctccctgggtcaagccctttgtacaccctaagcctccgcctcctcttcctcc<br>atccgccccgtctctccccccttgaacctcctcgttcgaccccgcctcgatcctccctttatccagccctcactcctt<br>ctctaggcgcccccatatggccatatgagatcttatatggggcacccccgccccttgtaaacttccctgaccctg<br>acatgacaagagttactaacagcccctctctccaagctcacttacaggctctctacttagtccagcacgaagtct<br>ggagacctctggcggcagcctaccaagaacaactggaccgaccggtggtacctcacccttaccgagtcggc<br>gacacagtgtgggtccgccgacaccagactaagaacctagaacctcgctggaaaggaccttacacagtcctg<br>ctgaccacccccaccgccctcaaagtagacggcatcgcagcttggatacacgccgcccacgtgaaggctgc<br>cgaccccgggggtggaccatcctctagactgctcgagaagcttgccaccatggccttaccagtgaccgccttg<br>ctcctgccgctggccttgctgctccacgccgccaggccggacatccagatgacacagactacatcctccctgt<br>ctgcctctctgggagacagagtcaccatcagttgcagggcaagtcaggacattagtaaatatttaaattggtatc<br>agcagaaaccagatggaactgttaaactcctgatctaccatacatcaagattacactcaggagtcccatcaagg<br>ttcagtggcagtgggtctggaacagattattctctcaccattagcaacctggagcaagaagatattgccacttact<br>tttgccaacagggtaatacgcttccgtacacgttcggaggggggaccaagctggagatcacaggtggcggtg<br>gctcgggcggtggtgggtcgggtggcggcggatctgaggtgaaactgcaggagtcaggacctggcctggt<br>ggcgccctcacagagcctgtccgtcacatgcactgtctcaggggtctcattacccgactatggtgtaagctgga<br>ttcgccagcctccacgaaagggtctggagtggctgggagtaatatggggtagtgaaaccacatactataattca<br>gctctcaaatccagactgaccatcatcaaggacaactccaagagccaagttttcttaaaaatgaacagtctgca<br>aactgatgacacagccatttactactgtgccaaacattattactacggtggtagctatgctatggactactggggc<br>caaggaacctcagtcaccgtctcctcaaccacgacgccagcgccgcgaccaccaacaccggcgcccacca<br>tcgcgtcgcagcccctgtccctgcgcccagaggcgtgccggccagcggcggggggcgcagtgcacacga<br>gggggctggacttcgcctgtgatatctacatctgggcgcccttggccgggacttgtggggtccttctcctgtcac<br>tggttatcaccctttactgcaaacggggcagaaagaaactcctgtatatattcaaacaaccatttatgagaccagt<br>acaaactactcaagaggaagatggctgtagctgccgatttccagaagaagaagaaggaggatgtgaactgag<br>agtgaagttcagcaggagcgcagacgcccccgcgtacaagcagggccagaaccagctctataacgagctc |

TABLE 1-continued

Exemplary sequences of stimulatory RNAs and others

| SEQ ID NO | Comment | Sequence |
|---|---|---|
| | | aatctaggacgaagagaggagtacgatgttttggacaagagacgtggccgggaccctgagatgggggaa |
| | | agccgagaaggaagaaccctcaggaaggcctgtacaatgaactgcagaaagataagatggcggaggccta |
| | | cagtgagattgggatgaaaggcgagcgccggaggggcaaggggcacgatggcctttaccagggtctcagt |
| | | acagccaccaaggacacctacgacgcccttcacatgcaggccctgccccctcgctaagcGGCCGCTT |
| | | TTTTTTTTTAATTAAAAGGTCGGGCAGGAAGAGGGCCTATTTCCC |
| | | ATGATTCCTTCATATTTGCATATACGATACAAGGCTGTTAGAGAGA |
| | | TAATTAGAATTAATTTGACTGTAAACACAAAGATATTAGTACAAA |
| | | ATACGTGACGTAGAAAGTAATAATTTCTTGGGTAGTTTGCAGTTTT |
| | | AAAATTATGTTTTAAAATGGACTATCATATGCTTACCGTAACTTGA |
| | | AAGTATTTCGATTTCTTGGCTTTATATATCTTGTGGAAAGGACGTC |
| | | TAGATCCGGAGCCGGGCGCGGTGGCGCGTGCCTGTAGTCCCAGCT |
| | | ACTCGGGAGGCTGAGGCTGGAGGATCGCTTGAGTCCAGGAGTTCT |
| | | GGGCTGTAGTGCGCTATGCCGATCGGGTGTCCGCACTAAGTTCGG |
| | | CATCAATATGGTGACCTCCCGGGAGCGGGGGACCACCAGGTTGCC |
| | | TAAGGAGGGGTGAACCGGCCCAGGTCGGAAACGGAGCAGGTCAA |
| | | AACTCCCGTGCTGATCAGTAGTGGGATCGCGCCTGTGAATAGCCA |
| | | CTGCACTCCAGCCTGGGCAACATAGCGAGACCCCGTCTCTTTTTTT |
| | | Gtcgacggtaccgcgggcccgggatccgataaaataaaagattttatttagtctccagaaaaaggggggaat |
| | | gaaagaccccacctgtaggtttggcaagctagcttaagtaacgccattttgcaaggcatggaaaatacataact |
| | | gagaatagagaagttcagatcaaggttaggaacagagagacagcagaatatgggccaaacaggatatctgtg |
| | | gtaagcagttcctgccccggctcagggccaagaacagatggtccccagatgcggtcccgccctcagcagttt |
| | | ctagagaaccatcagatgtttccagggtgccccaaggacctgaaaatgaccctgtgccttatttgaactaacca |
| | | atcagttcgcttctcgcttctgttcgcgcgcttctgctccccgagctcaataaaagagcccacaacccctcactc |
| | | ggcgcgccagtcctccgatagactgcgtcgcccgggtacccgtgtatccaataaaccctcttgcagttgcatcc |
| | | gacttgtggtctcgctgttccttgggagggtctcctctgagtgattgactacccgtcagcgggggtctttcatggg |
| | | taacagtttcttgaagttggagaacaacattctgagggtaggagtcgaatattaagtaatcctgactcaattagcc |
| | | actgttttgaatccacatactccaatactcctgaaatccatcgatggagttcattatggacagcgcagaaagagct |
| | | ggggagaattgtgaaattgttatccgctcacaattccacacaacatacgagccggaagcataaagtgtaaagc |
| | | ctggggtgcctaatgagtgagctaactcacattaattgcgttgcgctcactgcccgctttccagtcgggaaacct |
| | | gtcgtgccagctgcattaatgaatcggccaacgcgcggggagaggcggtttgcgtattgggcgctcttccgct |
| | | tcctcgctcactgactcgctgcgctcggtcgttcggctgcggcgagcggtatcagctcactcaaaggcggtaa |
| | | tacggttatccacagaatcaggggataacgcaggaaagaacatgtgagcaaaaggccagcaaaaggccag |
| | | gaaccgtaaaaaggccgcgttgctggcgtttttccataggctccgcccccctgacgagcatcacaaaaatcga |
| | | cgctcaagtcagaggtggcgaaacccgacaggactataaagataccaggcgtttccccctggaagctccctc |
| | | gtgcgctctcctgttccgaccctgccgcttaccggatacctgtccgcctttctcccttcgggaagcgtggcgcttt |
| | | ctcatagctcacgctgtaggtatctcagttcggtgtaggtcgttcgctccaagctgggctgtgtgcacgaacccc |
| | | ccgttcagcccgaccgctgcgccttatccggtaactatcgtcttgagtccaacccggtaagacacgacttatcg |
| | | ccactggcagcagccactggtaacaggattagcagagcgaggtatgtaggcggtgctacagagttcttgaag |
| | | tggtggcctaactacggctacactagaaggacagtatttggtatctgcgctctgctgaagccagttaccttcgga |
| | | aaaagagttggtagctcttgatccggcaaacaaaccaccgctggtagcggtggtttttttgtttgcaagcagcag |
| | | attacgcgcagaaaaaaaggatctcaagaagatcctttgatcttttctacggggtctgacgctcagtggaacga |
| | | aaactcacgttaagggattttggtcatgagattatcaaaaaggatcttcacctagatccttttaaattaaaaatgaa |
| | | gttttaaatcaatctaaagtatatatgagtaaacttggtctgacagttaccaatgcttaatcagtgaggcacctatct |
| | | cagcgatctgtctatttcgttcatccatagttgcctgactccccgtcgtgtagataactacgatacgggagggctt |
| | | accatctggccccagtgctgcaatgataccgcgagacccacgctcaccggctccagatttatcagcaataaac |
| | | cagccagccggaagggccgagcgcagaagtggtcctgcaactttatccgcctccatccagtctattaattgttg |
| | | ccgggaagctagagtaagtagttcgccagttaatagtttgcgcaacgttgttgccattgctacaggcatcgtggt |
| | | gtcacgctcgtcgtttggtatggcttcattcagctccggttcccaacgatcaaggcgagttacatgatcccccat |
| | | gttgtgcaaaaaagcggttagctccttcggtcctccgatcgttgtcagaagtaagttggccgcagtgttatcactc |
| | | atggttatggcagcactgcataattctcttactgtcatgccatccgtaagatgcttttctgtgactggtgagtactca |
| | | accaagtcattctgagaatagtgtatgcggcgaccgagttgctcttgcccggcgtcaatacgggataataccgc |
| | | gccacatagcagaactttaaaagtgctcatcattggaaaacgttcttcggggcgaaaactctcaaggatcttacc |
| | | gctgttgagatccagttcgatgtaacccactcgtgcacccaactgatcttcagcatcttttactttcaccagcgtttc |
| | | tgggtgagcaaaaacaggaaggcaaaatgccgcaaaaaagggaataagggcgacacggaaatgttgaata |
| | | ctcatactcttcctttttcaatattattgaagcatttatcagggttattgtctcatgagcggatacatatttgaatgtattt |
| | | agaaaaataaacaaataggggttccgcgcacatttccccgaaaagtgccacctgacgtctaagaaaccattatt |
| | | atcatgacattaacctataaaaataggcgtatcacgaggccctttcgtctcgcgcgtttcggtgatgacggtgaa |
| | | aacctctgacacatgcagctcccggagacggtcacagcttgtctgtaagcggatgccgggagcagacaagc |
| | | ccgtcagggcgcgtcagcgggtgttggcgggtgtcggggctggcttaactatgcggcatcagagcagattgt |
| | | actgagagtgcaccatatgcggtgtgaaataccgcacagatgcgtaaggagaaaataccgcatcaggcgcc |
| | | attcgccattcaggctgcgcaactgttgggaagggcgatcggtgcgggcctcttcgctattacgccagctggc |
| | | gaaagggggatgtgctgcaaggcgattaagttgggtaacgccagggttttcccagtcacgacgttgtaaaacg |
| | | acggccagtgccacgctctcccttatgcgactcctgcattaggaagcagcccagtagtaggttgaggccgttg |
| | | agcaccgccgccgcaaggaatggtgcatgcaaggagatggcgcccaacagtcccccggccacggggcct |
| | | gccaccatacccacgccgaaacaagcgctcatgagcccgaagtggcgagcccgatcttccccatcggtgat |
| | | gtcggcgatataggcgccagcaaccgcacctgtggcgccggtgatgccggccacgatgcgtccggcgtag |
| | | aggcgatttaaagacaggatatcagtggtccaggctctagttttgactcaacaatatcaccagctgaagcctata |
| | | gagtacgagccatagataaaataaaagattttatttagtctccagaaaaaggggggaa |
| SEQ ID NO: 850 | 19BBz-U6-Scr Uni-directional | tgaaagaccccacctgtaggtttggcaagctagcttaagtaacgccattttgcaaggcatggaaaatacataact |
| | | gagaatagagaagttcagatcaaggttaggaacagagagacagcagaatatgggccaaacaggatatctgtg |
| | | gtaagcagttcctgccccggctcagggccaagaacagatggtccccagatgcggtcccgccctcagcagttt |
| | | ctagagaaccatcagatgtttccagggtgccccaaggacctgaaaatgaccctgtgccttatttgaactaacca |
| | | atcagttcgcttctcgcttctgttcgcgcgcttctgctccccgagctcaataaaagagcccacaacccctcactc |
| | | ggcgcgccagtcctccgatagactgcgtcgcccgggtacccgtattcccaataaagcctcttgctgtttgcatc |

TABLE 1-continued

Exemplary sequences of stimulatory RNAs and others

| SEQ ID NO | Comment | Sequence |
| --- | --- | --- |
| | | cgaatcgtggactcgctgatccttgggagggtctcctcagattgattgactgcccacctcgggggtctttcatttg<br>gaggttccaccgagatttggagacccctgcctagggaccaccgacccccccgccgggaggtaagctggcc<br>agcggtcgtttcgtgtctgtctctgtctttgtgcgtgtttgtgccggcatctaatgtttgcgcctgcgtctgtactagt<br>tagctaactagctctgtatctggcggacccgtggtggaactgacgagttcggaacacccggccgcaaccctg<br>ggagacgtcccagggacttcgggggccgtttttgtggcccgacctgagtccaaaaatcccgatcgttttggact<br>ctttggtgcacccccttagaggagggatatgtggttctggtaggagacgagaacctaaaacagttcccgcctc<br>cgtctgaatttttgctttcggtttgggaccgaagccgcgccgcgcgtcttgtctgctgcagcatcgttctgtgttgt<br>ctctgtctgactgtgtttctgtatttgtctgagaatatgggcccgggctagcctgttaccactcccttaagtttgacc<br>ttaggtcactggaaagatgtcgagcggatcgctcacaaccagtcggtagatgtcaagaagagacgttgggtta<br>ccttctgctctgcagaatggccaacctttaacgtcggatggccgcgagacggcacctttaaccgagacctcatc<br>acccaggttaagatcaaggtcttttcacctggcccgcatggacacccagaccaggtcccctacatcgtgacct<br>gggaagccttggcttttgacccccctccctgggtcaagccctttgtacaccctaagcctccgcctcctcttcctcc<br>atccgccccgtctctccccttgaacctcctcgttcgaccccgcctcgatcctccctttatccagccctcactcctt<br>ctctaggcgccccatatggccatatgagatcttatatggggcacccccgccccttgtaaacttccctgaccctg<br>acatgacaagagttactaacagcccctctctccaagctcacttacaggctctctacttagtccagcacgaagtct<br>ggagacctctggcggcagcctaccaagaacaactggaccgaccggtggtacctcacccttaccgagtcggc<br>gacacagtgtgggtccgccgacaccagactaagaacctagaacctcgctggaaaggaccttacacagtcctg<br>ctgaccacccccaccgccctcaaagtagacggcatcgcagcttggatacacgccgcccacgtgaaggctgc<br>cgaccccgggggtggaccatcctctagactgctcgagaagcttgccaccatggccttaccagtgaccgccttg<br>ctcctgccgctggccttgctgctccacgccgccaggccggacatccagatgacacagactacatcctccctgt<br>ctgcctctctgggagacagagtcaccatcagttgcagggcaagtcaggacattagtaaatatttaaattggtatc<br>agcagaaaccagatggaactgttaaactcctgatctaccatacatcaagattacactcaggagtcccatcaagg<br>ttcagtggcagtgggtctggaacagattattctctcaccattagcaacctggagcaagaagatattgccacttact<br>tttgccaacagggtaatacgcttccgtacacgttcggaggggggaccaagctggagatcacaggtggcggtg<br>gctcgggcggtggtgggtcgggtggcggcggatctgaggtgaaactgcaggagtcaggacctggcctggt<br>ggcgccctcacagagcctgtccgtcacatgcactgtctcaggggtctcattacccgactatggtgtaagctgga<br>ttcgccagcctccacgaaagggtctggagtggctgggagtaatatggggtagtgaaaccacatactataattca<br>gctctcaaatccagactgaccatcatcaaggacaactccaagagccaagttttcttaaaaatgaacagtctgca<br>aactgatgacacagccatttactactgtgccaaacattattactacggtggtagctatgctatggactactggggc<br>caaggaacctcagtcaccgtctcctcaaccacgacgccagcgccgcgaccaccaacaccggcgcccacca<br>tcgcgtcgcagcccctgtccctgcgcccagaggcgtgccggccagcggcgggggggcgcagtgcacacga<br>gggggctggacttcgcctgtgatatctacatctgggcgcccttggccgggacttgtggggtccttctcctgtcac<br>tggttatcaccctttactgcaaacggggcagaaagaaactcctgtatatattcaaacaaccatttatgagaccagt<br>acaaactactcaagaggaagatggctgtagctgccgatttccagaagaagaagaaggaggatgtgaactgag<br>agtgaagttcagcaggagcgcagacgcccccgcgtacaagcagggccagaaccagctctataacgagctc<br>aatctaggacgaagagaggagtacgatgttttggacaagagacgtggccgggaccctgagatggggggaa<br>agccgagaaggaagaaccctcaggaaggcctgtacaatgaactgcagaaagataagatggcggaggccta<br>cagtgagattgggatgaaaggcgagcgccggaggggcaaggggcacgatggcctttaccagggtctcagt<br>acagccaccaaggacacctacgacgcccttcacatgcaggccctgccccctcgctaagcGGCCGCTT<br>TTTTTTTTTTAATTAAAAGGTCGGGCAGGAAGAGGGCCTATTTCCC<br>ATGATTCCTTCATATTTGCATATACGATACAAGGCTGTTAGAGAGA<br>TAATTAGAATTAATTTGACTGTAAACACAAAGATATTAGTACAAA<br>ATACGTGACGTAGAAAGTAATAATTTCTTGGGTAGTTTGCAGTTTT<br>AAAATTATGTTTTAAAATGGACTATCATATGCTTACCGTAACTTGA<br>AAGTATTTCGATTTCTTGGCTTTATATATCTTGTGGAAAGGACGTC<br>TAGATCCGGATTCACATGGGCGACCTACCGCGACAGTAGGTGGTT<br>TCGCTGTGGAGCTTCGCGGGAACATTCTCACTCCGCAGTGTCCCGT<br>TAAACGGCGGGGCTGGTGCCCGGACAGGGGCGGGGTGTCTACCAG<br>TGGTCACGCTCACTTTGGCGAGACGACCGCAGTCCGAATAAATGC<br>ATGAGGCGGGCCGCACAAGCTGAAGAGAACTCCGATGGGCGGGG<br>TATCCACCCGGCCCGTGGGGGATATGATGCCAGCTCGGTCCAACG<br>AGCGGTTAGGGCGACCCTTGCGGCGATATGTCGAGTCCGTTTTTTG<br>tcgacggtaccgcgggcccgggatccgataaaataaaagattttatttagtctccagaaaaaggggggaatga<br>aagaccccacctgtaggtttggcaagctagcttaagtaacgccattttgcaaggcatggaaaatacataactga<br>gaatagagaagttcagatcaaggttaggaacagagagacagcagaatatgggccaaacaggatatctgtggt<br>aagcagttcctgccccggctcagggccaagaacagatggtccccagatgcggtcccgccctcagcagtttct<br>agagaaccatcagatgtttccagggtgccccaaggacctgaaaatgaccctgtgccttatttgaactaaccaat<br>cagttcgcttctcgcttctgttcgcgcgcttctgctccccgagctcaataaaagagcccacaacccctcactcgg<br>cgcgccagtcctccgatagactgcgtcgcccgggtacccgtgtatccaataaaccctcttgcagttgcatccga<br>cttgtggtctcgctgttccttgggagggtctcctctgagtgattgactacccgtcagcgggggtctttcatgggta<br>acagtttcttgaagttggagaacaacattctgagggtaggagtcgaatattaagtaatcctgactcaattagccac<br>tgttttgaatccacatactccaatactcctgaaatccatcgatggagttcattatggacagcgcagaaagagctg<br>gggagaattgtgaaattgttatccgctcacaattccacacaacatacgagccggaagcataaagtgtaaagcct<br>ggggtgcctaatgagtgagctaactcacattaattgcgttgcgctcactgcccgctttccagtcgggaaacctgt<br>cgtgccagctgcattaatgaatcggccaacgcgcggggagaggcggtttgcgtattgggcgctcttccgcttc<br>ctcgctcactgactcgctgcgctcggtcgttcggctgcggcgagcggtatcagctcactcaaaggcggtaata<br>cggttatccacagaatcaggggataacgcaggaaagaacatgtgagcaaaaggccagcaaaaggccagga<br>accgtaaaaaggccgcgttgctggcgtttttccataggctccgcccccctgacgagcatcacaaaaatcgacg<br>ctcaagtcagaggtggcgaaacccgacaggactataaagataccaggcgtttccccctggaagctccctcgt<br>gcgctctcctgttccgaccctgccgcttaccggatacctgtccgcctttctcccttcgggaagcgtggcgctttct<br>catagctcacgctgtaggtatctcagttcggtgtaggtcgttcgctccaagctgggctgtgtgcacgaacccccc<br>cgttcagcccgaccgctgcgccttatccggtaactatcgtcttgagtccaacccggtaagacacgacttatcgc<br>cactggcagcagccactggtaacaggattagcagagcgaggtatgtaggcggtgctacagagttcttgaagt<br>ggtggcctaactacggctacactagaaggacagtatttggtatctgcgctctgctgaagccagttaccttcgga<br>aaaagagttggtagctcttgatccggcaaacaaaccaccgctggtagcggtggtttttttgtttgcaagcagcag |

TABLE 1-continued

Exemplary sequences of stimulatory RNAs and others

| SEQ ID NO | Comment | Sequence |
|---|---|---|
| | | attacgcgcagaaaaaaaggatctcaagaagatcctttgatcttttctacggggtctgacgctcagtggaacga |
| | | aaactcacgttaagggattttggtcatgagattatcaaaaaggatcttcacctagatccttttaaattaaaaatgaa |
| | | gttttaaatcaatctaaagtatatatgagtaaacttggtctgacagttaccaatgcttaatcagtgaggcacctatct |
| | | cagcgatctgtctatttcgttcatccatagttgcctgactccccgtcgtgtagataactacgatacgggagggctt |
| | | accatctggccccagtgctgcaatgataccgcgagacccacgctcaccggctccagatttatcagcaataaac |
| | | cagccagccggaagggccgagcgcagaagtggtcctgcaactttatccgcctccatccagtctattaattgttg |
| | | ccgggaagctagagtaagtagttcgccagttaatagtttgcgcaacgttgttgccattgctacaggcatcgtggt |
| | | gtcacgctcgtcgtttggtatggcttcattcagctccggttcccaacgatcaaggcgagttacatgatcccccat |
| | | gttgtgcaaaaaagcggttagctccttcggtcctccgatcgttgtcagaagtaagttggccgcagtgttatcactc |
| | | atggttatggcagcactgcataattctcttactgtcatgccatccgtaagatgcttttctgtgactggtgagtactca |
| | | accaagtcattctgagaatagtgtatgcggcgaccgagttgctcttgcccggcgtcaatacgggataataccgc |
| | | gccacatagcagaactttaaaagtgctcatcattggaaaacgttcttcggggcgaaaactctcaaggatcttacc |
| | | gctgttgagatccagttcgatgtaacccactcgtgcacccaactgatcttcagcatcttttactttcaccagcgtttc |
| | | tgggtgagcaaaaacaggaaggcaaaatgccgcaaaaaagggaataagggcgacacggaaatgttgaata |
| | | ctcatactcttcctttttcaatattattgaagcatttatcagggttattgtctcatgagcggatacatatttgaatgtattt |
| | | agaaaaataaacaaataggggttccgcgcacatttccccgaaaagtgccacctgacgtctaagaaaccattatt |
| | | atcatgacattaacctataaaaataggcgtatcacgaggccctttcgtctcgcgcgtttcggtgatgacggtgaa |
| | | aacctctgacacatgcagctcccggagacggtcacagcttgtctgtaagcggatgccgggagcagacaagc |
| | | ccgtcagggcgcgtcagcgggtgttggcgggtgtcggggctggcttaactatgcggcatcagagcagattgt |
| | | actgagagtgcaccatatgcggtgtgaaataccgcacagatgcgtaaggagaaaataccgcatcaggcgcc |
| | | attcgccattcaggctgcgcaactgttgggaagggcgatcggtgcgggcctcttcgctattacgccagctggc |
| | | gaaagggggatgtgctgcaaggcgattaagttgggtaacgccagggttttcccagtcacgacgttgtaaaacg |
| | | acggccagtgccacgctctcccttatgcgactcctgcattaggaagcagcccagtagtaggttgaggccgttg |
| | | agcaccgccgccgcaaggaatggtgcatgcaaggagatggcgcccaacagtcccccggccacggggcct |
| | | gccaccatacccacgccgaaacaagcgctcatgagcccgaagtggcgagcccgatcttccccatcggtgat |
| | | gtcggcgatataggcgccagcaaccgcacctgtggcgccggtgatgccggccacgatgcgtccggcgtag |
| | | aggcgatttaaagacaggatatcagtggtccaggctctagttttgactcaacaatatcaccagctgaagcctata |
| | | gagtacgagccatagataaaataaaagattttatttagtctccagaaaaaggggggaa |

Chemical Modifications to RNAs

An RNA described herein may be chemically modified to enhance stability or other beneficial characteristics. Modifications include, for example, (a) end modifications, e.g., 5' end modifications (phosphorylation, conjugation, inverted linkages, etc.) or 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position, or having an acyclic sugar) or replacement of the sugar, as well as (d) backbone modifications, including modification or replacement of the phosphodiester linkages.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included. Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Modified RNAs may also contain one or more substituted sugar moieties. The RNAs can include one of the following at the 2' position: OH; F; O—, S—, or N-alkyl; O—, S—, or N-alkenyl; O—, S— or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)._nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, RNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, and other substituents having similar properties. In some embodiments, the modification includes a 2'-methoxyethoxy (2'-O—$CH_2CH_2OCH_3$, also known as 2'-O-(2-methoxyethyl) or 2'-MOE) i.e., an alkoxy-alkoxy group. Another exemplary modification is 2'-dimethylaminooxyethoxy, i.e., a $O(CH_2)_2ON(CH_3)_2$ group, also known as 2'-DMAOE, and 2'-dimethylaminoethoxyethoxy (also known as 2'-O-dimethylaminoethoxyethyl or 2'-DMAEOE), i.e., 2'-O—$CH_2$—O—$CH_2$—$N(CH_2)_2$. In some embodiments, the RNA comprises one or more acyclic nucleotides (or nucleosides). The RNA can include one or more locked nucleic acids (LNA), e.g., a nucleotide having a modified ribose moiety in which the ribose moiety comprises an extra bridge connecting, e.g., the 2' and 4' carbons.

An RNA may also include nucleobase modifications or substitutions. Unmodified or natural nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. In some embodiments, the RNA includes one or more G-clamp nucleotides (a modified cytosine analog wherein the modifications confer the ability to hydrogen bond both Watson-Crick and Hoogsteen faces of a complementary guanine within a duplex).

Stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others.

Additional chemical modifications are disclosed, e.g., in WO2015/051318 (e.g., at pages 75-83 therein), which application is herein incorporated by reference in its entirety.

RNA Conjugates, e.g., for Targeting

An RNA described herein may be conjugated to a functional moiety, e.g., to alter stability or biodistribution. In some embodiments, the RNA is conjugated to a moiety that targets cancer cells or a tumor microenvironment. For instance, the RNA may be conjugated to a targeting moiety that binds cancer cells, e.g., by binding a surface protein characteristic of cancer cells and/or of the type of tissue from which the cancer arises. In embodiments, the targeting moiety binds the same antigen that the CAR binds, e.g., CD19, BCMA, EGFRvIII, or mesothelin. The targeting moiety may be, e.g., an antibody molecule such as a single chain antibody molecule.

In some embodiments, an RNA is chemically linked to one or more ligands, moieties or conjugates, which may confer functionality, e.g., by enhancing the activity, distribution, or half-life of the RNA. Such moieties include lipid moieties such as a cholesterol moiety, cholic acid, a thioether, e.g., beryl-S-tritylthiol, a thiocholesterol, an aliphatic chain, e.g., dodecandiol or undecyl residues, a phospholipid, e.g., di-hexadecyl-rac-glycerol or triethyl-ammonium 1,2-di-O-hexadecyl-rac-glycero-3-phosphonate, a polyamine or a polyethylene glycol chain, or adamantane acetic acid, a palmityl moiety, or an octadecylamine or hexylamino-carbonyloxycholesterol moiety.

Ligands can also include targeting groups, e.g., a cell or tissue targeting agent, e.g., a lectin, glycoprotein, lipid or protein, e.g., an antibody molecule, that binds to a specified cell type such as a cancer cell or a cell in a tumor microenvironment. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyamino-acids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic. In some embodiments, the ligand comprises a carbohydrate, e.g., a GalNAc ligand that comprises one or more N-acetylgalactosamine (GalNAc) or a derivative thereof.

Additional conjugates are disclosed, e.g., in WO2015/051318 (e.g., at pages 91-107 therein), which application is herein incorporated by reference in its entirety.

In embodiments, the conjugate is attached to the RNA via a linker. Exemplary linkers are disclosed, e.g., in WO2015/051318 (e.g., at pages 107-116 therein), which application is herein incorporated by reference in its entirety.

RNA Delivery and Formulations

The delivery of an RNA to a subject can be achieved directly, e.g., by administering a composition comprising the RNA to a subject, or indirectly, by administering a vector that encode the RNA, e.g., administering a cell comprising the vector.

In some embodiments, the RNA molecule (e.g., an exogenous RNA molecule), e.g., a stimulatory RNA molecule, e.g., an immune stimulatory RNA molecule, disclosed herein is delivered indirectly by administering to a subject a cell comprising a vector encoding the RNA molecule. In some embodiments, the expression of the RNA molecule is regulatable. In some embodiments, the expression of the RNA molecule is mediated by a promoter that does not exist naturally in the subject (e.g., a Gal4 promoter), and the activation of the promoter is regulated by a synthetic Notch (synNotch) peptide. Exemplary synNotch-mediated expression systems have been disclosed previously. See, e.g., Roybal et al., Cell. 2016 Feb. 11; 164(4):770-9, and WO2017/193059, herein incorporated by reference in their entirety. In some embodiments, the synNotch peptide comprises (i) an extracellular recognition domain (e.g., an scFv domain) that recognizes a target ligand (e.g., a tumor antigen), (ii) a transmembrane domain comprising a ligand-inducible proteolytic cleavage site, and (iii) an intracellular domain comprising a transcription factor (e.g., a Gal4 DNA-binding domain). Binding of the synNotch peptide to the target ligand leads to cleavage of the transmembrane domain of the synNotch peptide and release of the transcription factor, which can in turn enter the nucleus and drive the expression of the RNA molecule.

In some embodiments, the RNA molecule is delivered by a CAR T cell which comprises a first nucleic acid sequence encoding a CAR molecule, a second nucleic acid sequence encoding a synNotch peptide, and a third nucleic acid sequence encoding the RNA molecule. The expression of the RNA molecule is regulated by the synNotch peptide as described above.

In some embodiments, the RNA molecule is delivered by a CAR T cell which comprises a first nucleic acid sequence encoding a CAR molecule and a second nucleic acid sequence encoding the RNA molecule. In some embodiments, the first and second nucleic acid sequences are disposed on a single nucleic acid molecule. In some embodiments, the first and second nucleic acid sequences are disposed on separate nucleic acid molecules.

In some embodiments, the RNA can be delivered directly using a nanoparticle, a dendrimer, a polymer, liposomes, or a cationic delivery system. Cationic lipids, dendrimers, or polymers can either be bound to an RNA, or induced to form a vesicle or micelle that encases an RNA. Some non-limiting examples of drug delivery systems useful for systemic delivery of RNAs include DOTAP, Oligofectamine, solid nucleic acid lipid particles, cardiolipin, polyethyleneimine, Arg-Gly-Asp (RGD) peptides, and polyamidoamines. In some embodiments, an RNA forms a complex with cyclodextrin for systemic administration.

In some embodiments, the RNA can be delivered as a liposomal formulation. Liposomes fall into two broad classes. Cationic liposomes are positively charged liposomes which interact with the negatively charged nucleic acid molecules to form a stable complex. Liposomes which are pH-sensitive or negatively-charged, entrap nucleic acid rather than complex with it. One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol or dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol. Liposomes may also comprise lipids derivatized with one or more hydrophilic polymers such as a PEG moiety. For instance, the liposome may comprise PEG-derivatized phospholipids, e.g., DSPE-PEG. The liposome may also comprise a surfactant, e.g., a natural or synthetic surfactant. The surfactant may be, e.g., nonionic, anionic, cationic, or amphoteric.

In some embodiments, the RNA is fully encapsulated in a lipid formulation, e.g., to form a SPLP, pSPLP, SNALP, or other nucleic acid-lipid particle. In some embodiments, the RNA is formulated in a lipid nanoparticle (LNP). SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference. XTC comprising formulations are described, e.g., in International Application No. PCT/US2010/022614, filed Jan. 29, 2010, which is hereby incorporated by reference. MC3 comprising formulations are described, e.g., in International Application No. PCT/US10/28224, filed Jun. 10, 2010, which is hereby incorporated by reference. C12-200 comprising formulations are described in International Application No. PCT/US10/33777, filed May 5, 2010, which are hereby incorporated by reference.

The RNA may be administered systemically or locally, e.g., by injection into a tumor or tumor microenvironment.

In some embodiments RNAs described herein can be delivered indirectly via administration of a vector (e.g., a vector within a cell) capable of directing expression of the RNA. Expression can be transient or sustained, depending upon the specific construct used and the target tissue or cell type. Transgenes can be introduced as a linear construct, a circular plasmid, or a viral vector, which can be an integrating or non-integrating vector. The transgene can also be constructed to permit it to be inherited as an extrachromosomal plasmid.

In some embodiments, the RNA can be expressed from the same nucleic acid as a CAR, e.g., wherein the RNA and the CAR share a single promoter or use two different promoters. In some embodiments, the RNA and the CAR are expressed from different nucleic acids, e.g., wherein the two nucleic acids are in the same cell or different cells.

In some embodiments, the RNA molecule, or the nucleic acid molecule encoding the RNA molecule, and the CAR-expressing cell are administered simultaneously. In some embodiments, the RNA molecule, or the nucleic acid molecule encoding the RNA molecule, and the CAR-expressing cell are administered sequentially, e.g., the RNA molecule, or the nucleic acid molecule encoding the RNA molecule, is administered prior to or subsequent to the administration of the CAR-expressing cell.

Additional RNA formulations and delivery methods are described, e.g., in WO2015/051318 (e.g., at pages 116-137 therein), which application is herein incorporated by reference in its entirety.

Chimeric Antigen Receptor (CAR)

In one aspect, disclosed herein are methods using a cell (e.g., a population of cells) that expresses a CAR molecule. In one aspect, an exemplary CAR construct comprises an optional leader sequence (e.g., a leader sequence described herein), an antigen binding domain (e.g., an antigen binding domain described herein), a hinge (e.g., a hinge region described herein), a transmembrane domain (e.g., a transmembrane domain described herein), and an intracellular stimulatory domain (e.g., an intracellular stimulatory domain described herein). In one aspect, an exemplary CAR construct comprises an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), an intracellular costimulatory signaling domain (e.g., a costimulatory signaling domain described herein) and/or an intracellular primary signaling domain (e.g., a primary signaling domain described herein).

Sequences of non-limiting examples of various components that can be part of a CAR molecule described herein, are listed in Table 2, where "aa" stands for amino acids, and "na" stands for nucleic acids that encode the corresponding peptide.

TABLE 2

Sequences of various components of CAR (aa-amino acid sequence, na-nucleic acid sequence).

| SEQ ID NO: | description | Sequence |
|---|---|---|
| SEQ ID NO: 624 | EF-1 promoter | CGTGAGGCTCCGGTGCCCGTCAGTGGGCAGAGCGCACATCGC<br>CCACAGTCCCCGAGAAGTTGGGGGGAGGGGTCGGCAATTGAA<br>CCGGTGCCTAGAGAAGGTGGCGCGGGGTAAACTGGGAAAGT<br>GATGTCGTGTACTGGCTCCGCCTTTTTCCCGAGGGTGGGGGAG<br>AACCGTATATAAGTGCAGTAGTCGCCGTGAACGTTCTTTTTCG<br>CAACGGGTTTGCCGCCAGAACACAGGTAAGTGCCGTGTGTGG<br>TTCCCGCGGGCCTGGCCTCTTTACGGGTTATGGCCCTTGCGTG<br>CCTTGAATTACTTCCACCTGGCTGCAGTACGTGATTCTTGATC<br>CCGAGCTTCGGGTTGGAAGTGGGTGGGAGAGTTCGAGGCCTT |

TABLE 2-continued

| SEQ ID NO: | description | Sequence |
|---|---|---|
| | | GCGCTTAAGGAGCCCCTTCGCCTCGTGCTTGAGTTGAGGCCTG GCCTGGGCGCTGGGGCCGCCGCGTGCGAATCTGGTGGCACCT TCGCGCCTGTCTCGCTGCTTTCGATAAGTCTCTAGCCATTTAA AATTTTTGATGACCTGCTGCGACGCTTTTTTTCTGGCAAGATA GTCTTGTAAATGCGGGCCAAGATCTGCACACTGGTATTTCGGT TTTTGGGGCCGCGGGCGGCGACGGGGCCCGTGCGTCCCAGCG CACATGTTCGGCGAGGCGGGGCCTGCGAGCGCGGCCACCGAG AATCGGACGGGGGTAGTCTCAAGCTGGCCGGCCTGCTCTGGT GCCTGGCCTCGCGCCGCCGTGTATCGCCCCGCCCTGGGCGGC AAGGCTGGCCCGGTCGGCACCAGTTGCGTGAGCGGAAAGATG GCCGCTTCCCGGCCCTGCTGCAGGGAGCTCAAAATGGAGGAC GCGGCGCTCGGGAGAGCGGGCGGGTGAGTCACCCACACAAA GGAAAAGGGCCTTTCCGTCCTCAGCCGTCGCTTCATGTGACTC CACGGAGTACCGGGCGCCGTCCAGGCACCTCGATTAGTTCTC GAGCTTTTGGAGTACGTCGTCTTTAGGTTGGGGGGAGGGGTTT TATGCGATGGAGTTTCCCCACACTGAGTGGGTGGAGACTGAA GTTAGGCCAGCTTGGCACTTGATGTAATTCTCCTTGGAATTTG CCCTTTTTGAGTTTGGATCTTGGTTCATTCTCAAGCCTCAGAC AGTGGTTCAAAGTTTTTTTCTTCCATTTCAGGTGTCGTGA |
| SEQ ID NO: 625 | Leader (aa) | MALPVTALLLPLALLLHAARP |
| SEQ ID NO: 626 | Leader (na) | ATGGCCCTGCCTGTGACAGCCCTGCTGCTGCCTCTGGCTCTGC TGCTGCATGCCGCTAGACCC |
| SEQ ID NO: 33 | Leader (na) | ATGGCCCTCCCTGTCACCGCCCTGCTGCTTCCGCTGGCTCTTC TGCTCCACGCCGCTCGGCCC |
| SEQ ID NO: 627 | CD8 hinge (aa) | TTTPAPRPPTPAPTIASQPLSLRPEACRPAAGGAVHTRGLDFACD |
| SEQ ID NO: 628 | CD8 hinge (na) | ACCACGACGCCAGCGCCGCGACCACCAACACCGGCGCCCACC ATCGCGTCGCAGCCCCTGTCCCTGCGCCCAGAGGCGTGCCGG CCAGCGGCGGGGGGCGCAGTGCACACGAGGGGGCTGGACTT CGCCTGTGAT |
| SEQ ID NO: 629 | Ig4 hinge (aa) | ESKYGPPCPPCPAPEFLGGPSVFLFPPKPKDTLMISRTPEVTCVVV DVSQEDPEVQFNWYVDGVEVHNAKTKPREEQFNSTYRVVSVLT VLHQDWLNGKEYKCKVSNKGLPSSIEKTISKAKGQPREPQVYTL PPSQEEMTKNQVSLTCLVKGFYPSDIAVEWESNGQPENNYKTTP PVLDSDGSFFLYSRLTVDKSRWQEGNVFSCSVMHEALHNHYTQ KSLSLSLGKM |
| SEQ ID NO: 630 | Ig4 hinge (na) | GAGAGCAAGTACGGCCCTCCCTGCCCCCCTTGCCCTGCCCCCG AGTTCCTGGGCGGACCCAGCGTGTTCCTGTTCCCCCCCAAGCC CAAGGACACCCTGATGATCAGCCGGACCCCCGAGGTGACCTG TGTGGTGGTGGACGTGTCCCAGGAGGACCCCGAGGTCCAGTT CAACTGGTACGTGGACGGCGTGGAGGTGCACAACGCCAAGAC CAAGCCCCGGGAGGAGCAGTTCAATAGCACCTACCGGGTGGT GTCCGTGCTGACCGTGCTGCACCAGGACTGGCTGAACGGCAA GGAATACAAGTGTAAGGTGTCCAACAAGGGCCTGCCCAGCAG CATCGAGAAAACCATCAGCAAGGCCAAGGGCCAGCCTCGGG AGCCCCAGGTGTACACCCTGCCCCCTAGCCAAGAGGAGATGA CCAAGAACCAGGTGTCCCTGACCTGCCTGGTGAAGGGCTTCT ACCCCAGCGACATCGCCGTGGAGTGGGAGAGCAACGGCCAG CCCGAGAACAACTACAAGACCACCCCCCCTGTGCTGGACAGC GACGGCAGCTTCTTCCTGTACAGCCGGCTGACCGTGGACAAG AGCCGGTGGCAGGAGGGCAACGTCTTTAGCTGCTCCGTGATG CACGAGGCCCTGCACAACCACTACACCCAGAAGAGCCTGAGC CTGTCCCTGGGCAAGATG |
| SEQ ID NO: 631 | IgD hinge (aa) | RWPESPKAQASSVPTAQPQAEGSLAKATTAPATTRNTGRGGEEK KKEKEKEEQEERETKTPECPSHTQPLGVYLLTPAVQDLWLRDKA TFTCFVVGSDLKDAHLTWEVAGKVPTGGVEEGLLERHSNGSQS QHSRLTLPRSLWNAGTSVTCTLNHPSLPPQRLMALREPAAQAPV KLSLNLLASSDPPEAASWLLCEVSGFSPPNILLMWLEDQREVNTS GFAPARPPPQPGSTTFWAWSVLRVPAPPSPQPATYTCVVSHEDS RTLLNASRSLEVSYVTDH |
| SEQ ID NO: 632 | IgD hinge (na) | AGGTGGCCCGAAAGTCCCAAGGCCCAGGCATCTAGTGTTCCT ACTGCACAGCCCCAGGCAGAAGGCAGCCTAGCCAAAGCTACT ACTGCACCTGCCACTACGCGCAATACTGGCCGTGGCGGGGAG GAGAAGAAAAAGGAGAAAGAGAAAGAAGAACAGGAAGAGA |

TABLE 2-continued

| Sequences of various components of CAR (aa-amino acid sequence, na-nucleic acid sequence). | | |
|---|---|---|
| SEQ ID NO: | description | Sequence |
| | | GGGAGACCAAGACCCCTGAATGTCCATCCCATACCCAGCCGC TGGGCGTCTATCTCTTGACTCCCGCAGTACAGGACTTGTGGCT TAGAGATAAGGCCACCTTTACATGTTTCGTCGTGGCTCTGAC CTGAAGGATGCCCATTTGACTTGGGAGGTTGCCGGAAAGGTA CCCACAGGGGGGGTTGAGGAAGGGTTGCTGGAGCGCCATTCC AATGGCTCTCAGAGCCAGCACTCAAGACTCACCCTTCCGAGA TCCCTGTGGAACGCCGGGACCTCTGTCACATGTACTCTAAATC ATCCTAGCCTGCCCCCACAGCGTCTGATGGCCCTTAGAGAGC CAGCCGCCCAGGCACCAGTTAAGCTTAGCCTGAATCTGCTCG CCAGTAGTGATCCCCCAGAGGCCGCCAGCTGGCTCTTATGCG AAGTGTCCGGCTTTAGCCCGCCCAACATCTTGCTCATGTGGCT GGAGGACCAGCGAGAAGTGAACACCAGCGGCTTCGCTCCAGC CCGGCCCCCACCCCAGCCGGGTTCTACCACATTCTGGGCCTGG AGTGTCTTAAGGGTCCCAGCACCACCTAGCCCCCAGCCAGCC ACATACACCTGTGTTGTGTCCCATGAAGATAGCAGGACCCTG CTAAATGCTTCTAGGAGTCTGGAGGTTTCCTACGTGACTGACC ATT |
| SEQ ID NO: 633 | GS hinge/linker (aa) | GGGGSGGGGS |
| SEQ ID NO: 634 | GS hinge/linker (na) | GGTGGCGGAGGTTCTGGAGGTGGAGGTTCC |
| SEQ ID NO: 635 | CD8 transmembrane (TM) (aa) | IYIWAPLAGTCGVLLLSLVITLYC |
| SEQ ID NO: 636 | CD8 transmembrane (TM) (na) | ATCTACATCTGGGCGCCCTTGGCCGGGACTTGTGGGGTCCTTC TCCTGTCACTGGTTATCACCCTTTACTGC |
| SEQ ID NO: 34 | CD8 TM (na) | ATCTACATTTGGGCCCCTCTGGCTGGTACTTGCGGGGTCCTGC TGCTTTCACTCGTGATCACTCTTTACTGT |
| SEQ ID NO: 637 | 4-1BB intracellular domain (aa) | KRGRKKLLYIFKQPFMRPVQTTQEEDGCSCRFPEEEEGGCEL |
| SEQ ID NO: 638 | 4-1BB intracellular domain (na) | AAACGGGGCAGAAAGAAACTCCTGTATATATTCAAACAACCA TTTATGAGACCAGTACAAACTACTCAAGAGGAAGATGGCTGT AGCTGCCGATTTCCAGAAGAAGAAGAAGGAGGATGTGAACT G |
| SEQ ID NO: 767 | 4-1BB intracellular domain (na) | AAGCGCGGTCGGAAGAAGCTGCTGTACATCTTTAAGCAACCC TTCATGAGGCCTGTGCAGACTACTCAAGAGGAGGACGGCTGT TCATGCCGGTTCCCAGAGGAGGAGGAAGGCGGCTGCGAACTG |
| SEQ ID NO: 639 | CD27 (aa) | QRRKYRSNKGESPVEPAEPCRYSCPREEEGSTIPIQEDYRKPEPAC SP |
| SEQ ID NO: 640 | CD27 (na) | AGGAGTAAGAGGAGCAGGCTCCTGCACAGTGACTACATGAAC ATGACTCCCCGCCGCCCCGGGCCCACCCGCAAGCATTACCAG CCCTATGCCCCACCACGCGACTTCGCAGCCTATCGCTCC |
| SEQ ID NO: 641 | CD3-zeta (aa) | RVKFSRSADAPAYKQGQNQLYNELNLGRREEYDVLDKRRGRDP EMGGKPRRKNPQEGLYNELQKDKMAEAYSEIGMKGERRRGKG HDGLYQGLSTATKDTYDALHMQALPPR |
| SEQ ID NO: 642 | CD3-zeta (na) | AGAGTGAAGTTCAGCAGGAGCGCAGACGCCCCCGCGTACAA GCAGGGCCAGAACCAGCTCTATAACGAGCTCAATCTAGGACG AAGAGAGGAGTACGATGTTTTGGACAAGAGACGTGGCCGGG ACCCTGAGATGGGGGGAAAGCCGAGAAGGAAGAACCCTCAG GAAGGCCTGTACAATGAACTGCAGAAAGATAAGATGGCGGA GGCCTACAGTGAGATTGGGATGAAAGGCGAGCGCCGGAGGG GCAAGGGGCACGATGGCCTTTACCAGGGTCTCAGTACAGCCA CCAAGGACACCTACGACGCCCTTCACATGCAGGCCCTGCCCC CTCGC |
| SEQ ID NO: 768 | CD3-zeta (na) | CGCGTGAAATTCAGCCGCAGCGCAGATGCTCCAGCCTACAAG CAGGGGCAGAACCAGCTCTACAACGAACTCAATCTTGGTCGG AGAGAGGAGTACGACGTGCTGGACAAGCGGAGAGGACGGGA |

TABLE 2-continued

| Sequences of various components of CAR (aa-amino acid sequence, na-nucleic acid sequence). | | |
|---|---|---|
| SEQ ID NO: | description | Sequence |
| | | CCCAGAAATGGGCGGGAAGCCGCGCAGAAAGAATCCCCAAG AGGGCCTGTACAACGAGCTCCAAAAGGATAAGATGGCAGAA GCCTATAGCGAGATTGGTATGAAAGGGGAACGCAGAAGAGG CAAAGGCCACGACGGACTGTACCAGGGACTCAGCACCGCCAC CAAGGACACCTATGACGCTCTTCACATGCAGGCCCTGCCGCC TCGG |
| SEQ ID NO: 643 | CD3-zeta (aa) | RVKFSRSADAPAYQQGQNQLYNELNLGRREEYDVLDKRRGRDP EMGGKPRRKNPQEGLYNELQKDKMAEAYSEIGMKGERRRGKG HDGLYQGLSTATKDTYDALHMQALPPR |
| SEQ ID NO: 644 | CD3-zeta (na) | AGAGTGAAGTTCAGCAGGAGCGCAGACGCCCCCGCGTACCAG CAGGGCCAGAACCAGCTCTATAACGAGCTCAATCTAGGACGA AGAGAGGAGTACGATGTTTTGGACAAGAGACGTGGCCGGGA CCCTGAGATGGGGGGAAAGCCGAGAAGGAAGAACCCTCAGG AAGGCCTGTACAATGAACTGCAGAAAGATAAGATGGCGGAG GCCTACAGTGAGATTGGGATGAAAGGCGAGCGCCGGAGGGG CAAGGGGCACGATGGCCTTTACCAGGGTCTCAGTACAGCCAC CAAGGACACCTACGACGCCCTTCACATGCAGGCCCTGCCCCC TCGC |
| SEQ ID NO: 645 | linker | GGGGS |
| SEQ ID NO: 646 | linker | GGTGGCGGAGGTTCTGGAGGTGGAGGTTCC |
| SEQ ID NO: 647 | PD-1 extracellular domain (aa) | Pgwfldspdrpwnpptfspallvvtegdnatftcsfsntsesfvlnwyrmspsnqtdklaafpedrs qpgqdcrfrvtqlpngrdfhmsvvrarrndsgtylcgaislapkaqikeslraelrvterraevptahp spsprpagqfqtlv |
| SEQ ID NO: 648 | PD-1 extracellular domain (na) | Cccggatggttctggactctccggatcgcccgtggaatcccccaaccttctcaccggcactcttggtt gtgactgagggcgataatgcgaccttcacgtgctcgttctccaacacctccgaatcattcgtgctgaact ggtaccgcatgagcccgtcaaaccagaccgacaagctcgccgcgtttccggaagatcggtcgcaac cgggacaggattgtcggttccgcgtgactcaactgccgaatggcagagacttccacatgagcgtggtc cgcgctaggcgaaacgactccgggacctacctgtgcggagccatctcgctggcgcctaaggcccaa atcaaagagagcttgagggccgaactgagagtgaccgagcgcagagctgaggtgccaactgcacat ccatccccatcgcctcggcctgcggggcagtttcagaccctggtc |
| SEQ ID NO: 649 | PD-1 CAR (aa) with signal | Malpvtalllplalllhaarppgwfldspdrpwnpptfspallvvtegdnatftcsfsntsesfvlnwy rmspsnqtdklaafpedrsqpgqdcrfrvtqlpngrdfhmsvvrarrndsgtylcgaislapkaqik eslraelrvterraevptahpspsprpagqfqtlvtapaprpptpaptiasqplslrpeacrpaaggav htrgldfacdiyiwaplagtcgvllllslvitlyckrgrkkllyifkqpfmrpvqttqeedgcscrfpeee eggcelrvkfsrsadapaykqgqnqlynelnlgrreeydvldlargrdpemggkprrknpqegly nelqkdkmaeayseigmkgerrrgkghdglyqglstatkdtydalhmqalppr |
| SEQ ID NO: 650 | PD-1 CAR (na) | Atggccctccctgtcactgccctgcttctccccctcgcactcctgctccacgccgctagaccacccgg atggtttctggactctccggatcgcccgtggaatcccccaaccttctcaccggcactcttggttgtgactg agggcgataatgcgaccttcacgtgctcgttctccaacacctccgaatcattcgtgctgaactggtaccg catgagcccgtcaaaccagaccgacaagctcgccgcgtttccggaagatcggtcgcaaccgggaca ggattgtcggttccgcgtgactcaactgccgaatggcagagacttccacatgagcgtggtccgcgcta ggcgaaacgactccgggacctacctgtgcggagccatctcgctggcgcctaaggcccaaatcaaag agagcttgagggccgaactgagagtgaccgagcgcagagctgaggtgccaactgcacatccatccc catcgcctcggcctgcggggcagtttcagaccctggtcacgaccactccggcgccgcgcccaccga ctccggccccaactatcgcgagccagcccctgtcgctgaggccggaagcatgccgccctgccgccg gaggtgctgtgcatacccggggattggacttcgcatgcgacatctacatttgggctcctctcgccggaa cttgtggcgtgctccttctgtccctggtcatcaccctgtactgcaagcggggtcggaaaaagcttctgta cattttcaagcagcccttcatgaggcccgtgcaaaccacccaggaggaggacggttgctcctgccggt tccccgaagaggaagaaggaggttgcgagctgcgcgtgaagttctcccggagcgccgacgccccc gcctataagcagggccagaaccagctgtacaacgaactgaacctgggacggcgggaagagtacgat gtgctggacaagcggcgcggccgggaccccgaaatgggcgggaagcctagaagaaagaaccctc aggaaggcctgtataacgagctgcagaaggacaagatggccgaggcctactccgaaattgggatga agggagagcggcggaggggaaaggggcacgacggcctgtaccaaggactgtccaccgccaccaa ggacacatacgatgccctgcacatgcaggcccttccccctcgc |
| SEQ ID NO: 28 | linker | (Gly-Gly-Gly-Ser)n, where n = 1-10 |
| SEQ ID NO: 29 | linker | (Gly4 Ser)4 |
| SEQ ID NO: 30 | linker | (Gly4 Ser)3 |

TABLE 2-continued

Sequences of various components of CAR (aa-amino acid sequence, na-nucleic acid sequence).

| SEQ ID NO: | description | Sequence |
|---|---|---|
| SEQ ID NO: 31 | linker | (Gly3Ser) |
| SEQ ID NO: 35 | linker | ASGGGGSGGRASGGGGS |
| SEQ ID NO: 32 | polyA | $[a]_{50-5000}$ |
| SEQ ID NO: 651 | PD1 CAR (aa) | Pgwfldspdrpwnpptfspallvvtegdnatftcsfsntsesfvlnwyrmspsnqtdklaafpedrs<br>gpgqdcrfrvtqlpngrdfhmsvvrarrndsgtylcgaislapkaqikeslraelrvterraevptahp<br>spsprpagqfqtlvtttpaprpptpaptiasqplslrpeacrpaaggavhtrgldfacdiyiwaplagt<br>cgvlllslvitlyckrgrkkllyifkqpfmrpvqttqeedgcscrfpeeeeggcelrvkfsrsadapay<br>kqgqnqlynelnlgrreeydvldlargrdpemggkprrknpqeglynelqkdkmaeayseigm<br>kgerrrgkghdglyqglstatkdtydalhmqalppr |
| SEQ ID NO: 769 | ICOS intracellular domain (aa) | TKKKYSSSVHDPNGEYMFMRAVNTAKKSRLTDVTL |
| SEQ ID NO: 808 | ICOS intracellular domain (na) | ACAAAAAAGAAGTATTCATCCAGTGTGCACGACCCTAACGGT<br>GAATACATGTTCATGAGAGCAGTGAACACAGCCAAAAAATCC<br>AGACTCACAGATGTGACCCTA |
| SEQ ID NO: 806 | ICOS TM domain (aa) | TTTPAPRPPTPAPTIASQPLSLRPEACRPAAGGAVHTRGLDFACD<br>FWLPIGCAAFVVVCILGCILICWL |
| SEQ ID NO: 807 | ICOS TM domain (na) | ACCACGACGCCAGCGCCGCGACCACCAACACCGGCGCCCACC<br>ATCGCGTCGCAGCCCCTGTCCCTGCGCCCAGAGGCGTGCCGG<br>CCAGCGGCGGGGGGCGCAGTGCACACGAGGGGGCTGGACTT<br>CGCCTGTGATTTCTGGTTACCCATAGGATGTGCAGCCTTTGTT<br>GTAGTCTGCATTTTGGGATGCATACTTATTTGTTGGCTT |
| SEQ ID NO: 770 | CD28 intracellular domain (aa) | RSKRSRLLHSDYMNMTPRRPGPTRKHYQPYAPPRDFAAYRS |
| SEQ ID NO: 809 | CD28 intracellular domain (na) | AGGAGTAAGAGGAGCAGGCTCCTGCACAGTGACTACATGAAC<br>ATGACTCCCCGCCGCCCCGGGCCCACCCGCAAGCATTACCAG<br>CCCTATGCCCCACCACGCGACTTCGCAGCCTATCGCTCC |

CAR Antigen Binding Domain

In one aspect, the portion of the CAR comprising the antigen binding domain comprises an antigen binding domain that targets a tumor antigen, e.g., a tumor antigen described herein. In some embodiments, the antigen binding domain binds to: CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); or immunoglobulin lambda-like polypeptide 1 (IGLL1).

The antigen binding domain can be any domain that binds to an antigen, including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

CAR Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CART.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIR2DS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO: 627. In one aspect, the transmembrane domain comprises (e.g., consists of) a transmembrane domain of SEQ ID NO: 635.

In one aspect, the hinge or spacer comprises an IgG4 hinge. For example, in one embodiment, the hinge or spacer comprises a hinge of the amino acid sequence of SEQ ID NO: 629. In some embodiments, the hinge or spacer comprises a hinge encoded by a nucleotide sequence of SEQ ID NO: 630.

In one aspect, the hinge or spacer comprises an IgD hinge. For example, in one embodiment, the hinge or spacer comprises a hinge of the amino acid sequence of SEQ ID NO: 631. In some embodiments, the hinge or spacer comprises a hinge encoded by a nucleotide sequence of SEQ ID NO: 632.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of SEQ ID NO: 633. In some embodiments, the linker is encoded by a nucleotide sequence of SEQ ID NO: 634.

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in a CAR described herein include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta, e.g., a CD3-zeta sequence described herein.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Costimulatory Signaling Domain

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. In one embodiment, the intracellular domain is designed to comprise the signaling domain of CD3-zeta and the signaling domain of CD28. In one aspect, the intracellular domain is designed to comprise the signaling domain of CD3-zeta and the signaling domain of ICOS.

A costimulatory molecule can be a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include CD5, ICAM-1, GITR, BAFFR, HVEM (LIGHTR), SLAMF7, NKp80 (KLRF1), NKp30, NKp44, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, NKG2D, NKG2C and PAG/Cbp.

The intracellular signaling sequences within the cytoplasmic portion of the CAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 637. In one aspect, the signaling domain of CD3-zeta is a signaling domain of SEQ ID NO: 641.

In one aspect, the intracellular signaling domain is designed to comprise the signaling domain of CD3-zeta and the signaling domain of CD27. In one aspect, the signaling domain of CD27 comprises an amino acid sequence of SEQ ID NO: 639. In one aspect, the signalling domain of CD27 is encoded by a nucleic acid sequence of SEQ ID NO: 640.

In one aspect, the CAR-expressing cell described herein can further comprise a second CAR, e.g., a second CAR that includes a different antigen binding domain, e.g., to the same target or a different target (e.g., a target other than a cancer associated antigen described herein or a different cancer associated antigen described herein, e.g., CD19, CD33, CLL-1, CD34, FLT3, or folate receptor beta). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, ICOS, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In another aspect, the disclosure features a population of CAR-expressing cells, e.g., CART cells. In some embodiments, the population of CAR-expressing cells comprises a mixture of cells expressing different CARs. For example, in one embodiment, the population of CART cells can include a first cell expressing a CAR having an antigen binding domain to a cancer associated antigen described herein, and a second cell expressing a CAR having a different antigen binding domain, e.g., an antigen binding domain to a different a cancer associated antigen described herein, e.g., an antigen binding domain to a cancer associated antigen described herein that differs from the cancer associate antigen bound by the antigen binding domain of the CAR expressed by the first cell. As another example, the population of CAR-expressing cells can include a first cell expressing a CAR that includes an antigen binding domain to a cancer associated antigen described herein, and a second cell expressing a CAR that includes an antigen binding domain to a target other than a cancer associate antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the disclosure features a population of cells wherein at least one cell in the population expresses a CAR having an antigen binding domain to a cancer associated antigen described herein, and a second cell expressing another agent, e.g., an agent which enhances the activity of a CAR-expressing cell. For example, in one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta). In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4 and TGF beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

CD19 CAR and CD19-Binding Sequences

In some embodiments, the CAR-expressing cell described herein is a CD19 CAR-expressing cell (e.g., a cell expressing a CAR that binds to human CD19).

In one embodiment, the antigen binding domain of the CD19 CAR has the same or a similar binding specificity as the FMC63 scFv fragment described in Nicholson et al. Mol. Immun 34 (16-17): 1157-1165 (1997). In one embodiment, the antigen binding domain of the CD19 CAR includes the scFv fragment described in Nicholson et al. *Mol. Immun.* 34 (16-17): 1157-1165 (1997).

In some embodiments, the CD19 CAR includes an antigen binding domain (e.g., a humanized antigen binding domain) according to Table 3 of WO2014/153270, incorporated herein by reference. WO2014/153270 also describes methods of assaying the binding and efficacy of various CAR constructs.

In one aspect, the parental murine scFv sequence is the CAR19 construct provided in PCT publication WO2012/079000 (incorporated herein by reference). In one embodiment, the anti-CD19 binding domain is a scFv described in WO2012/079000.

In one embodiment, the CAR molecule comprises the fusion polypeptide sequence provided as SEQ ID NO: 12 in PCT publication WO2012/079000, which provides an scFv fragment of murine origin that specifically binds to human CD19.

In one embodiment, the CD19 CAR comprises an amino acid sequence provided as SEQ ID NO: 12 in PCT publication WO2012/079000. In embodiment, the amino acid sequence is (MALPVTALLLPLALLLHAARP)diqmtqttsslsaslgdrvt-iscrasqdiskylnwyqqkpdgtvklliyhtsrlhsg vpsrfsgsgsgtdysltis-nleqediatyfcqqgntlpytfgggtkleitggggsggggsggggsevklqe-sgpglvapsqslsvtctvsgvslpdyg vswirqpprkglewlgviwgset-tyynsalksrltiikdnsksqvflkmnslqtddtaiyycakhyyyggsya-mdywgqgtsvtvsstapaprp ptpaptiasqplslrpeacrpaaggavhtr-gldfacdiyiwaplagtcgvlllslvitlyckrgrkkllyiflcqpfmrpv-qttqeedgcscrfpeeeegg celrvkfsrsadapaykqgqnqlynelnlgr-reeydvldlargrdpemggkprrknpqeglynelqkdkmaeaysei-gmkgeragkghdgl yqglstatkdtydalhmqalppr (SEQ ID NO: 847), or a sequence substantially homologous thereto. The optional sequence of the signal peptide is shown in capital letters and parenthesis.

In one embodiment, the amino acid sequence is:

Diqmtqttsslsaslgdrvtiscrasqdiskylnwyqqkpdgtvklli-yhtsrlhsgvpsrfsgsgsgtdysltisnleqediatyfcqqgn tlpytfgggt-kleitggggsggggsggggsevklqesgpglvapsqslsvtctvsg-vslpdygvswirqpprkglewlgviwgsettyynsalksr ltiikdnsksq-vflkmnslqtddtaiyycakhyyyggsyamdywgqgtsvtvsstapaprppt-paptiasqplslrpeacrpaaggavhtrgldfa cdiyiwaplagtcgvlllslvit-lyckrgrkkllyiflcqpfmrpvqttqeedgcscrfpeeeeggcelrvkfsrs-adapaykqgqnqlynelnlgrre eydvldkagrdpemggkprrknpqeg-lynelqkdkmaeayseigmkgeragkghdglyqglstatkdtydalhm-qalppr (SEQ ID NO: 848), or a sequence substantially homologous thereto.

In one embodiment, the CD19 CAR has the USAN designation TISAGENLECLEUCEL-T. In embodiments, CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CD19 CAR comprises an antigen binding domain (e.g., a humanized antigen binding domain) according to Table 3 of WO2014/153270, incorporated herein by reference.

Humanization of murine CD19 antibody is desired for the clinical setting, where the mouse-specific residues may induce a human-anti-mouse antigen (HAMA) response in patients who receive CART19 treatment, i.e., treatment with T cells transduced with the CAR19 construct. The production, characterization, and efficacy of humanized CD19 CAR sequences is described in International Application WO2014/153270 which is herein incorporated by reference in its entirety, including Examples 1-5 (p. 115-159).

In some embodiments, CD19 CAR constructs are described in PCT publication WO 2012/079000, incorporated herein by reference, and the amino acid sequence of the murine CD19 CAR and scFv constructs are shown in Table 3 below, or a sequence substantially identical to any of the aforesaid sequences (e.g., at least 85%, 90%, 95% or more identical to any of the sequences described herein).

TABLE 3

CD19 CAR Constructs

| SEQ ID NO | Region |
|---|---|
| CTL019 | |
| SEQ ID NO: 773 | CTL019 Full amino acid sequence |
| SEQ ID NO: 840 | CTL019 Full nucleotide sequence |
| SEQ ID NO: 774 | CTL019 scFv domain |
| mCAR1 | |
| SEQ ID NO: 775 | mCAR1 scFv |
| SEQ ID NO: 776 | mCAR1 Full amino acid sequence |
| mCAR2 | |
| SEQ ID NO: 777 | mCAR2 scFv |
| SEQ ID NO: 778 | mCAR2 amino acid sequence |
| SEQ ID NO: 779 | mCAR2 full amino acid sequence |
| mCAR3 | |
| SEQ ID NO: 780 | mCAR3 scFv |
| SEQ ID NO: 781 | mCAR3 full amino acid sequence |
| SSJ25-C1 | |
| SEQ ID NO: 811 | SSJ25-C1 VH sequence |
| SEQ ID NO: 812 | SSJ25-C1 VL |
| Humanized CAR1 | |
| SEQ ID NO: 813 | CAR1 scFv domain |
| SEQ ID NO: 814 | CAR 1 - Full - aa |
| Humanized CAR2 | |
| SEQ ID NO: 815 | CAR2 scFv domain - aa |
| SEQ ID NO: 816 | CAR2 scFv domain - nt |
| SEQ ID NO: 817 | CAR 2 - Full - aa |
| SEQ ID NO: 818 | CAR 2 - Full - nt |
| SEQ ID NO: 819 | CAR2 - Soluble scFv - aa |
| Humanized CAR3 | |
| SEQ ID NO: 820 | CAR3 scFv domain |
| SEQ ID NO: 821 | CAR 3 - Full - aa |
| Humanized CAR4 | |
| SEQ ID NO: 822 | CAR4 scFv domain |
| SEQ ID NO: 823 | CAR 4 - Full - aa |
| Humanized CAR5 | |
| SEQ ID NO: 824 | CAR5 scFv domain |
| SEQ ID NO: 825 | CAR 5 - Full - aa |
| Humanized CAR6 | |
| SEQ ID NO: 826 | CAR6 scFv domain |
| SEQ ID NO: 827 | CAR6 -Full - aa |
| Humanized CAR7 | |
| SEQ ID NO: 828 | CAR7 scFv domain |
| SEQ ID NO: 829 | CAR 7 Full - aa |
| Humanized CAR8 | |
| SEQ ID NO: 830 | CAR8 scFv domain |
| SEQ ID NO: 831 | CAR 8 - Full - aa |
| Humanized CAR9 | |
| SEQ ID NO: 832 | CAR9 scFv domain |
| SEQ ID NO: 833 | CAR 9 - Full - aa |
| Humanized CAR10 | |
| SEQ ID NO: 834 | CAR10 scFv domain |
| SEQ ID NO: 835 | CAR 10 Full - aa |
| Humanized CAR11 | |
| SEQ ID NO: 836 | CAR11 scFv domain |
| SEQ ID NO: 837 | CAR 11 Full - aa |
| Humanized CAR12 | |
| SEQ ID NO: 838 | CAR12 scFv domain |
| SEQ ID NO: 839 | CAR 12 - Full - aa |

TABLE 3-continued

| CD19 CAR Constructs | |
|---|---|
| SEQ ID NO | Region |
| Murine CART19 | |
| SEQ ID NO: 782 | HCDR1 (Kabat) |
| SEQ ID NO: 783 | HCDR2 (Kabat) |
| SEQ ID NO: 784 | HCDR3 (Kabat) |
| SEQ ID NO: 785 | LCDR1 (Kabat) |
| SEQ ID NO: 786 | LCDR2 (Kabat) |
| SEQ ID NO: 787 | LCDR3 (Kabat) |
| Humanized CART19 a | |
| SEQ ID NO: 788 | HCDR1 (Kabat) |
| SEQ ID NO: 789 | HCDR2 (Kabat) |
| SEQ ID NO: 790 | HCDR3 (Kabat) |
| SEQ ID NO: 791 | LCDR1 (Kabat) |
| SEQ ID NO: 792 | LCDR2 (Kabat) |
| SEQ ID NO: 793 | LCDR3 (Kabat) |
| Humanized CART19 b | |
| SEQ ID NO: 794 | HCDR1 (Kabat) |
| SEQ ID NO: 795 | HCDR2 (Kabat) |
| SEQ ID NO: 796 | HCDR3 (Kabat) |
| SEQ ID NO: 797 | LCDR1 (Kabat) |
| SEQ ID NO: 798 | LCDR2 (Kabat) |
| SEQ ID NO: 799 | LCDR3 (Kabat) |
| Humanized CART19 c | |
| SEQ ID NO: 800 | HCDR1 (Kabat) |
| SEQ ID NO: 801 | HCDR2 (Kabat) |
| SEQ ID NO: 802 | HCDR3 (Kabat) |
| SEQ ID NO: 803 | LCDR1 (Kabat) |
| SEQ ID NO: 804 | LCDR2 (Kabat) |
| SEQ ID NO: 805 | LCDR3 (Kabat) |

CD19 CAR constructs containing humanized anti-CD19 scFv domains are described in PCT publication WO 2014/153270, incorporated herein by reference.

The sequences of murine and humanized CDR sequences of the anti-CD19 scFv domains are shown in Table 4 for the heavy chain variable domains and in Table 5 for the light chain variable domains. The SEQ ID NOs refer to those found in Table 3.

TABLE 4

| Heavy Chain Variable Domain CDR (Kabat) SEQ ID NO's of CD19 Antibodies | | | |
|---|---|---|---|
| Candidate | HCDR1 | HCDR2 | HCDR3 |
| murine_CART19 | SEQ ID NO: 782 | SEQ ID NO: 783 | SEQ ID NO: 784 |
| humanized_CART19 a | SEQ ID NO: 788 | SEQ ID NO: 789 | SEQ ID NO: 790 |
| humanized_CART19 b | SEQ ID NO: 794 | SEQ ID NO: 795 | SEQ ID NO: 796 |
| humanized_CART19 c | SEQ ID NO: 800 | SEQ ID NO: 801 | SEQ ID NO: 802 |

TABLE 5

| Light Chain Variable Domain CDR (Kabat) SEQ ID NO's of CD19 Antibodies | | | |
|---|---|---|---|
| Candidate | LCDR1 | LCDR2 | LCDR3 |
| murine_CART19 | SEQ ID NO: 785 | SEQ ID NO: 786 | SEQ ID NO: 787 |
| humanized_CART19 a | SEQ ID NO: 791 | SEQ ID NO: 792 | SEQ ID NO: 793 |
| humanized_CART19 b | SEQ ID NO: 797 | SEQ ID NO: 798 | SEQ ID NO: 799 |
| humanized_CART19 c | SEQ ID NO: 803 | SEQ ID NO: 804 | SEQ ID NO: 805 |

Any known CD19 CAR, e.g., the CD19 antigen binding domain of any known CD19 CAR, in the art can be used in accordance with the present disclosure. For example, LG-740; CD19 CAR described in the U.S. Pat. Nos. 8,399,645; 7,446,190; Xu et al., Leuk Lymphoma. 2013 54(2): 255-260(2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10.

Exemplary CD19 CARs include CD19 CARs described herein, e.g., in one or more tables described herein, or an anti-CD19 CAR described in Xu et al. Blood 123.24(2014): 3750-9; Kochenderfer et al. Blood 122.25(2013):4129-39, Cruz et al. Blood 122.17(2013):2965-73, NCT00586391, NCT01087294, NCT02456350, NCT00840853, NCT02659943, NCT02650999, NCT02640209, NCT01747486, NCT02546739, NCT02656147, NCT02772198, NCT00709033, NCT02081937, NCT00924326, NCT02735083, NCT02794246, NCT02746952, NCT01593696, NCT02134262, NCT01853631, NCT02443831, NCT02277522, NCT02348216, NCT02614066, NCT02030834, NCT02624258, NCT02625480, NCT02030847, NCT02644655, NCT02349698, NCT02813837, NCT02050347, NCT01683279, NCT02529813, NCT02537977, NCT02799550, NCT02672501, NCT02819583, NCT02028455, NCT01840566, NCT01318317, NCT01864889, NCT02706405, NCT01475058, NCT01430390, NCT02146924, NCT02051257, NCT02431988, NCT01815749, NCT02153580, NCT01865617, NCT02208362, NCT02685670, NCT02535364, NCT02631044, NCT02728882, NCT02735291, NCT01860937, NCT02822326, NCT02737085, NCT02465983, NCT02132624, NCT02782351, NCT01493453, NCT02652910, NCT02247609, NCT01029366, NCT01626495, NCT02721407, NCT01044069, NCT00422383, NCT01680991, NCT02794961, or NCT02456207, each of which is incorporated herein by reference in its entirety.

BCMA CAR and BCMA-Binding Sequences

In some embodiments, the CAR-expressing cell described herein is a BCMA CAR-expressing cell (e.g., a cell express ing a CAR that binds to human BCMA). Exemplary BCMA CARs can include sequences disclosed in Table 1 or 16 of WO2016/014565, incorporated herein by reference. The BCMA CAR construct can include an optional leader sequence; an optional hinge domain, e.g., a CD8 hinge domain; a transmembrane domain, e.g., a CD8 transmembrane domain; an intracellular domain, e.g., a 4-1BB intracellular domain; and a functional signaling domain, e.g., a CD3 zeta domain. In certain embodiments, the domains are contiguous and in the same reading frame to form a single fusion protein. In other embodiments, the domain are in separate polypeptides, e.g., as in an RCAR molecule as described herein.

The sequences of exemplary BCMA CAR molecules or fragments thereof are disclosed in Tables 6, 7, and 8. In certain embodiments, the full length BCMA CAR molecule includes one or more CDRs, VH, VL, scFv, or full-length sequences of, BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, as disclosed in Tables 6, 7, and 8, or a sequence substantially (e.g., 95-99%) identical thereto.

Additional exemplary BCMA-targeting sequences that can be used in the anti-BCMA CAR constructs are disclosed in WO 2017/021450, WO 2017/011804, WO 2017/025038, WO 2016/090327, WO 2016/130598, WO 2016/210293, WO 2016/090320, WO 2016/014789, WO 2016/094304, WO 2016/154055, WO 2015/166073, WO 2015/188119, WO 2015/158671, U.S. Pat. Nos. 9,243,058, 8,920,776, 9,273,141, 7,083,785, 9,034,324, US 2007/0049735, US 2015/0284467, US 2015/0051266, US 2015/0344844, US 2016/0131655, US 2016/0297884, US 2016/0297885, US 2017/0051308, US 2017/0051252, US 2017/0051252, WO 2016/020332, WO 2016/087531, WO 2016/079177, WO 2015/172800, WO 2017/008169, U.S. Pat. No. 9,340,621, US 2013/0273055, US 2016/0176973, US 2015/0368351, US 2017/0051068, US 2016/0368988, and US 2015/0232557, herein incorporated by reference in their entirety. In some embodiments, additional exemplary BCMA CAR constructs are generated using the VH and VL sequences from PCT Publication WO2012/0163805 (the contents of which are hereby incorporated by reference in its entirety).

TABLE 6

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| 139109 | |
| 139109- aa ScFv domain | 49 |
| 139109- nt ScFv domain | 64 |
| 139109- aa VH | 79 |
| 139109- aa VL | 94 |
| 139109- aa Full CAR | 109 |
| 139109- nt Full CAR | 124 |

TABLE 6-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| Full CAR without leader sequence | 392 |
| Full CAR without linker, without leader sequence | 393 |
| 139103 | |
| 139103- aa ScFv domain | 39 |
| 139103- nt ScFv domain | 54 |
| 139103- aa VH | 69 |
| 139103- aa VL | 84 |
| 139103- aa Full CAR | 99 |
| 139103- nt Full CAR | 114 |
| 139105 | |
| 139105- aa ScFv domain | 40 |
| 139105- nt ScFv domain | 55 |
| 139105- aa VH | 70 |
| 139105- aa VL | 85 |
| 139105- aa Full CAR | 100 |
| 139105- nt Full CAR | 115 |
| 139111 | |
| 139111- aa ScFv domain | 41 |
| 139111- nt ScFv domain | 56 |
| 139111- aa VH | 71 |
| 139111- aa VL | 86 |
| 139111- aa Full CAR | 101 |
| 139111- nt Full CAR | 116 |
| 139100 | |
| 139100- aa ScFv domain | 42 |
| 139100- nt ScFv domain | 57 |
| 139100- aa VH | 72 |
| 139100- aa VL | 87 |
| 139100- aa Full CAR | 102 |
| 139100- nt Full CAR | 117 |
| 139101 | |
| 139101- aa ScFv domain | 43 |
| 139101- nt ScFv domain | 58 |
| 139101- aa VH | 73 |
| 139101- aa VL | 88 |
| 139101- aa Full CAR | 103 |
| 139101- nt Full CAR | 118 |
| 139102 | |
| 139102- aa ScFv domain | 44 |
| 139102- nt ScFv domain | 59 |
| 139102- aa VH | 74 |
| 139102- aa VL | 89 |
| 139102- aa Full CAR | 104 |
| 139102- nt Full CAR | 119 |
| 139104 | |
| 139104- aa ScFv domain | 45 |
| 139104- nt ScFv domain | 60 |
| 139104- aa VH | 75 |
| 139104- aa VL | 90 |
| 139104- aa Full CAR | 105 |
| 139104- nt Full CAR | 120 |
| 139106 | |
| 139106- aa ScFv domain | 46 |
| 139106- nt ScFv domain | 61 |
| 139106- aa VH | 76 |
| 139106- aa VL | 91 |
| 139106- aa Full CAR | 106 |
| 139106- nt Full CAR | 121 |
| 139107 | |
| 139107- aa ScFv domain | 47 |
| 139107- nt ScFv domain | 62 |
| 139107- aa VH | 77 |

TABLE 6-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| 139107- aa VL | 92 |
| 139107- aa Full CAR | 107 |
| 139107- nt Full CAR | 122 |
| 139108 | |
| 139108- aa ScFv domain | 48 |
| 139108- nt ScFv domain | 63 |
| 139108- aa VH | 78 |
| 139108- aa VL | 93 |
| 139108- aa Full CAR | 108 |
| 139108- nt Full CAR | 123 |
| 139110 | |
| 139110- aa ScFv domain | 50 |
| 139110- nt ScFv domain | 65 |
| 139110- aa VH | 80 |
| 139110- aa VL | 95 |
| 139110- aa Full CAR | 110 |
| 139110- nt Full CAR | 125 |
| 139112 | |
| 139112- aa ScFv domain | 51 |
| 139112- nt ScFv domain | 66 |
| 139112- aa VH | 81 |
| 139112- aa VL | 96 |
| 139112- aa Full CAR | 111 |
| 139112- nt Full CAR | 126 |
| 139113 | |
| 139113- aa ScFv domain | 52 |
| 139113- nt ScFv domain | 67 |
| 139113- aa VH | 82 |
| 139113- aa VL | 97 |
| 139113- aa Full CAR | 112 |
| 139113- nt Full CAR | 127 |
| 139114 | |
| 139114- aa ScFv domain | 53 |
| 139114- nt ScFv domain | 68 |
| 139114- aa VH | 83 |
| 139114- aa VL | 98 |
| 139114- aa Full CAR | 113 |
| 139114- nt Full CAR | 128 |
| 149362 | |
| 149362-aa ScFv domain | 129 |
| 149362-nt ScFv domain | 150 |
| 149362-aa VH | 171 |
| 149362-aa VL | 192 |
| 149362-aa Full CAR | 213 |
| 149362-nt Full CAR | 234 |
| 149363 | |
| 149363-aa ScFv domain | 130 |
| 149363-nt ScFv domain | 151 |
| 149363-aa VH | 172 |
| 149363-aa VL | 193 |
| 149363-aa Full CAR | 214 |
| 149363-nt Full CAR | 235 |
| 149364 | |
| 149364-aa ScFv domain | 131 |
| 149364-nt ScFv domain | 152 |
| 149364-aa VH | 173 |
| 149364-aa VL | 194 |
| 149364-aa Full CAR | 215 |
| 149364-nt Full CAR | 236 |
| 149365 | |
| 149365-aa ScFv domain | 132 |
| 149365-nt ScFv domain | 153 |
| 149365-aa VH | 174 |
| 149365-aa VL | 195 |
| 149365-aa Full CAR | 216 |
| 149365-nt Full CAR | 237 |
| 149366 | |
| 149366-aa ScFv domain | 133 |
| 149366-nt ScFv domain | 154 |
| 149366-aa VH | 175 |
| 149366-aa VL | 196 |
| 149366-aa Full CAR | 217 |
| 149366-nt Full CAR | 238 |
| 149367 | |
| 149367-aa ScFv domain | 134 |
| 149367-nt ScFv domain | 155 |
| 149367-aa VH | 176 |
| 149367-aa VL | 197 |
| 149367-aa Full CAR | 218 |
| 149367-nt Full CAR | 239 |
| 149368 | |
| 149368-aa ScFv domain | 135 |
| 149368-nt ScFv domain | 156 |
| 149368-aa VH | 177 |
| 149368-aa VL | 198 |
| 149368-aa Full CAR | 219 |
| 149368-nt Full CAR | 240 |
| 149369 | |
| 149369-aa ScFv domain | 136 |
| 149369-nt ScFv domain | 157 |
| 149369-aa VH | 178 |
| 149369-aa VL | 199 |
| 149369-aa Full CAR | 220 |
| 149369-nt Full CAR | 241 |
| BCMA__EBB-C1978-A4 | |
| BCMA__EBB-C1978-A4 - aa ScFv domain | 137 |
| BCMA__EBB-C1978-A4 - nt ScFv domain | 158 |
| BCMA__EBB-C1978-A4 - aa VH | 179 |
| BCMA__EBB-C1978-A4 - aa VL | 200 |
| BCMA__EBB-C1978-A4 - aa Full CART | 221 |
| BCMA__EBB-C1978-A4 - nt Full CART | 242 |
| BCMA__EBB-C1978-G1 | |
| BCMA__EBB-C1978-G1 - aa ScFv domain | 138 |
| BCMA__EBB-C1978-G1 - nt ScFv domain | 159 |
| BCMA__EBB-C1978-G1 - aa VH | 180 |
| BCMA__EBB-C1978-G1 - aa VL | 201 |
| BCMA__EBB-C1978-G1 - aa Full CART | 222 |
| BCMA__EBB-C1978-G1 - nt Full CART | 243 |
| BCMA__EBB-C1979-C1 | |
| BCMA__EBB-C1979-C1 - aa ScFv domain | 139 |
| BCMA__EBB-C1979-C1 - nt ScFv domain | 160 |
| BCMA__EBB-C1979-C1 - aa VH | 181 |
| BCMA__EBB-C1979-C1 - aa VL | 202 |
| BCMA__EBB-C1979-C1 - aa Full CART | 223 |
| BCMA__EBB-C1979-C1 - nt Full CART | 244 |
| BCMA__EBB-C1978-C7 | |
| BCMA__EBB-C1978-C7 - aa ScFv domain | 140 |
| BCMA__EBB-C1978-C7 - nt ScFv domain | 161 |
| BCMA__EBB-C1978-C7 - aa VH | 182 |
| BCMA__EBB-C1978-C7 - aa VL | 203 |
| BCMA__EBB-C1978-C7 - aa Full CART | 224 |
| BCMA__EBB-C1978-C7 - nt Full CART | 245 |
| BCMA__EBB-C1978-D10 | |
| BCMA__EBB-C1978-D10 - aa ScFv domain | 141 |
| BCMA__EBB-C1978-D10- nt ScFv domain | 162 |
| BCMA__EBB-C1978-D10 - aa VH | 183 |

TABLE 6-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| BCMA_EBB-C1978-D10- aa VL | 204 |
| BCMA_EBB-C1978-D10 - aa Full CART | 225 |
| BCMA_EBB-C1978-D10 - nt Full CART | 246 |
| BCMA_EBB-C1979-C12 | |
| BCMA_EBB-C1979-C12- aa ScFv domain | 142 |
| BCMA_EBB-C1979-C12 - nt ScFv domain | 163 |
| BCMA_EBB-C1979-C12 - aa VH | 184 |
| BCMA_EBB-C1979-C12 - aa VL | 205 |
| BCMA_EBB-C1979-C12 - aa Full CART | 226 |
| BCMA_EBB-C1979-C12 - nt Full CART | 247 |
| BCMA_EBB-C1980-G4 | |
| BCMA_EBB- C1980-G4- aa ScFv domain | 143 |
| BCMA_EBB- C1980-G4- nt ScFv domain | 164 |
| BCMA_EBB- C1980-G4- aa VH | 185 |
| BCMA_EBB- C1980-G4- aa VL | 206 |
| BCMA_EBB- C1980-G4- aa Full CART | 227 |
| BCMA_EBB- C1980-G4- nt Full CART | 248 |
| BCMA_EBB-C1980-D2 | |
| BCMA_EBB- C1980-D2- aa ScFv domain | 144 |
| BCMA_EBB- C1980-D2- nt ScFv domain | 165 |
| BCMA_EBB- C1980-D2- aa VH | 186 |
| BCMA_EBB- C1980-D2- aa VL | 207 |
| BCMA_EBB- C1980-D2- aa Full CART | 228 |
| BCMA_EBB- C1980-D2- nt Full CART | 249 |
| BCMA_EBB-C1978-A10 | |
| BCMA_EBB- C1978-A10- aa ScFv domain | 145 |
| BCMA_EBB- C1978-A10- nt ScFv domain | 166 |
| BCMA_EBB- C1978-A10- aa VH | 187 |
| BCMA_EBB- C1978-A10- aa VL | 208 |

TABLE 6-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| BCMA_EBB- C1978-A10- aa Full CART | 229 |
| BCMA_EBB- C1978-A10- nt Full CART | 250 |
| BCMA_EBB-C1978-D4 | |
| BCMA_EBB- C1978-D4- aa ScFv domain | 146 |
| BCMA_EBB- C1978-D4- nt ScFv domain | 167 |
| BCMA_EBB- C1978-D4- aa VH | 188 |
| BCMA_EBB- C1978-D4- aa VL | 209 |
| BCMA_EBB- C1978-D4- aa Full CART | 230 |
| BCMA_EBB- C1978-D4- nt Full CART | 251 |
| BCMA_EBB-C1980-A2 | |
| BCMA_EBB- C1980-A2- aa ScFv domain | 147 |
| BCMA_EBB- C1980-A2- nt ScFv domain | 168 |
| BCMA_EBB- C1980-A2- aa VH | 189 |
| BCMA_EBB- C1980-A2- aa VL | 210 |
| BCMA_EBB- C1980-A2- aa Full CART | 231 |
| BCMA_EBB- C1980-A2- nt Full CART | 252 |
| BCMA_EBB-C1981-C3 | |
| BCMA_EBB- C1981-C3- aa ScFv domain | 148 |
| BCMA_EBB- C1981-C3- nt ScFv domain | 169 |
| BCMA_EBB- C1981-C3- aa VH | 190 |
| BCMA_EBB- C1981-C3- aa VL | 211 |
| BCMA_EBB- C1981-C3- aa Full CART | 232 |
| BCMA_EBB- C1981-C3- nt Full CART | 253 |
| BCMA_EBB-C1978-G4 | |
| BCMA_EBB- C1978-G4- aa ScFv domain | 149 |
| BCMA_EBB- C1978-G4- nt ScFv domain | 170 |
| BCMA_EBB- C1978-G4- aa VH | 191 |
| BCMA_EBB- C1978-G4- aa VL | 212 |
| BCMA_EBB- C1978-G4- aa Full CART | 233 |
| BCMA_EBB- C1978-G4- nt Full CART | 254 |

TABLE 7

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| 139109 | NHGMS | 394 | GIVYSGSTYYAASVKG | 434 | HGGESDV | 474 |
| 139103 | NYAMS | 384 | GISRSGENTYYADSVKG | 424 | SPAHYYGGMDV | 464 |
| 139105 | DYAMH | 385 | GISWNSGSIGYADSVKG | 425 | HSFLAY | 465 |
| 139111 | NHGMS | 386 | GIVYSGSTYYAASVKG | 426 | HGGESDV | 466 |
| 139100 | NFGIN | 387 | WINPKNNNTNYAQKFQG | 427 | GPYYYQSYMDV | 467 |
| 139101 | SDAMT | 388 | VISGSGGTTYYADSVKG | 428 | LDSSGYYYARGPRY | 468 |
| 139102 | NYGIT | 389 | WISAYNGNTNYAQKFQG | 429 | GPYYYYMDV | 469 |
| 139104 | NHGMS | 390 | GIVYSGSTYYAASVKG | 430 | HGGESDV | 470 |

TABLE 7-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| 139106 | NHGMS | 391 | GIVYSGSTYYAASVKG | 431 | HGGESDV | 471 |
| 139107 | NHGMS | 771 | GIVYSGSTYYAASVKG | 432 | HGGESDV | 472 |
| 139108 | DYYMS | 772 | YISSSGSTIYYADSVKG | 433 | ESGDGMDV | 473 |
| 139110 | DYYMS | 395 | YISSSGNTIYYADSVKG | 435 | STMVREDY | 475 |
| 139112 | NHGMS | 396 | GIVYSGSTYYAASVKG | 436 | HGGESDV | 476 |
| 139113 | NHGMS | 397 | GIVYSGSTYYAASVKG | 437 | HGGESDV | 477 |
| 139114 | NHGMS | 398 | GIVYSGSTYYAASVKG | 438 | HGGESDV | 478 |
| 149362 | SSYYYWG | 399 | SIYYSGSAYYNPSLKS | 439 | HWQEWPDAFDI | 479 |
| 149363 | TSGMCVS | 400 | RIDWDEDKFYSTSLKT | 440 | SGAGGTSATAFDI | 480 |
| 149364 | SYSMN | 401 | SISSSSSYIYYADSVKG | 441 | TIAAVYAFDI | 481 |
| 149365 | DYYMS | 402 | YISSSGSTIYYADSVKG | 442 | DLRGAFDI | 482 |
| 149366 | SHYIH | 403 | MINPSGGVTAYSQTLQG | 443 | EGSGSGWYFDF | 483 |
| 149367 | SGGYYWS | 404 | YIYYSGSTYYNPSLKS | 444 | AGIAARLRGAFDI | 484 |
| 149368 | SYAIS | 405 | GIIPIFGTANYAQKFQG | 445 | RGGYQLLRWDVGLLRSAFDI | 485 |
| 149369 | SNSAAWN | 406 | RTYYRSKWYSFYAISLKS | 446 | SSPEGLFLYWFDP | 486 |
| BCMA_EBB-C1978-A4 | SYAMS | 407 | AISGSGGSTYYADSVKG | 447 | VEGSGSLDY | 487 |
| BCMA_EBB-C1978-G1 | RYPMS | 408 | GISDSGVSTYYADSAKG | 448 | RAGSEASDI | 488 |
| BCMA_EBB-C1979-C1 | SYAMS | 409 | AISGSGGSTYYADSVKG | 449 | ATYKRELRYYYGMDV | 489 |
| BCMA_EBB-C1978-C7 | SYAMS | 410 | AISGSGGSTYYADSVKG | 450 | ATYKRELRYYYGMDV | 490 |
| BCMA_EBB-C1978-D10 | DYAMH | 411 | GISWNSGSIGYADSVKG | 451 | VGKAVPDV | 491 |
| BCMA_EBB-C1979-C12 | DYAMH | 412 | SINWKGNSLAYGDSVKG | 452 | HQGVAYYNYAMDV | 492 |
| BCMA_EBB-C1980-G4 | SYAMS VKG | 413 | AISGSGGSTYYADS | 453 | VVRDGMDV | 493 |
| BCMA_EBB-C1980-D2 | SYAMS | 414 | AISGSGGSTYYADSVKG | 454 | IPQTGTFDY | 494 |

TABLE 7-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| BCMA_EBB-C1978-A10 | SYAMS | 415 | AISGSGGSTYYADSVKG | 455 | ANYKRELRYYYGMDV | 495 |
| BCMA_EBB-C1978-D4 | SYAMS | 416 | AISGSGGSTYYADSVKG | 456 | ALVGATGAFDI | 496 |
| BCMA_EBB-C1980-A2 | SYAMS | 417 | AISGSGGSTYYADSVKG | 457 | WFGEGFDP | 497 |
| BCMA_EBB-C1981-C3 | SYAMS | 418 | AISGSGGSTYYADSVKG | 458 | VGYDSSGYYRDYYGMDV | 498 |
| BCMA_EBB-C1978-G4 | SYAMS | 419 | AISGSGGSTYYADSVKG | 459 | MGWSSGYLGAFDI | 499 |
| A7D12.2 | NFGMN | 420 | WINTYTGESYFADDFKG | 460 | GEIYYGYDGGFAY | 500 |
| C11D5.3 | DYSIN | 421 | WINTETREPAYAYDFRG | 461 | DYSYAMDY | 501 |
| C12A3.2 | HYSMN | 422 | RINTESGVPIYADDFKG | 462 | DYLYSLDF | 502 |
| C13F12.1 | HYSMN | 423 | RINTETGEPLYADDFKG | 463 | DYLYSCDY | 503 |

TABLE 8

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | SEQ ID NO | LCDR2 | SEQ ID NO | LCDR3 | SEQ ID NO |
|---|---|---|---|---|---|---|
| 139109 | RASQSISSYLN | 514 | AASSLQS | 554 | QQSYSTPYT | 594 |
| 139103 | RASQSISSSFLA | 504 | GASRRAT | 544 | QQYHSSPSWT | 584 |
| 139105 | RSSQSLLHSNGYNYLD | 505 | LGSNRAS | 545 | MQALQTPYT | 585 |
| 139111 | KSSQSLLRNDGKTPLY | 506 | EVSNRFS | 546 | MQNIQFPS | 586 |
| 139100 | RSSQSLLHSNGYNYLN | 507 | LGSKRAS | 547 | MQALQTPYT | 587 |
| 139101 | RASQSISSYLN | 508 | GASTLAS | 548 | QQSYKRAS | 588 |
| 139102 | RSSQSLLYSNGYNYVD | 509 | LGSNRAS | 549 | MQGRQFPYS | 589 |
| 139104 | RASQSVSSNLA | 510 | GASTRAS | 550 | QQYGSSLT | 590 |
| 139106 | RASQSVSSKLA | 511 | GASIRAT | 551 | QQYGSSSWT | 591 |
| 139107 | RASQSVGSTNLA | 512 | DASNRAT | 552 | QQYGSSPPWT | 592 |
| 139108 | RASQSISSYLN | 513 | AASSLQS | 553 | QQSYTLA | 593 |
| 139110 | KSSESLVHNSGKTYLN | 515 | EVSNRDS | 555 | MQGTHWPGT | 595 |
| 139112 | QASEDINKFLN | 516 | DASTLQT | 556 | QQYESLPLT | 596 |
| 139113 | RASQSVGSNLA | 517 | GASTRAT | 557 | QQYNDWLPVT | 597 |

TABLE 8-continued

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | SEQ ID NO | LCDR2 | SEQ ID NO | LCDR3 | SEQ ID NO |
|---|---|---|---|---|---|---|
| 139114 | RASQSIGSSSLA | 518 | GASSRAS | 558 | QQYAGSPPFT | 598 |
| 149362 | KASQDIDDAMN | 519 | SATSPVP | 559 | LQHDNFPLT | 599 |
| 149363 | RASQDIYNNLA | 520 | AANKSQS | 560 | QHYYRFPYS | 600 |
| 149364 | RSSQSLLHSNGYNYLD | 521 | LGSNRAS | 561 | MQALQTPYT | 601 |
| 149365 | GGNNIGTKSVH | 522 | DDSVRPS | 562 | QVWDSDSEHVV | 602 |
| 149366 | SGDGLSKKYVS | 523 | RDKERPS | 563 | QAWDDTTVV | 603 |
| 149367 | RASQGIRNWLA | 524 | AASNLQS | 564 | QKYNSAPFT | 604 |
| 149368 | GGNNIGSKSVH | 525 | GKNNRPS | 565 | SSRDSSGDHLRV | 605 |
| 149369 | QGDSLGNYYAT | 526 | GTNNRPS | 566 | NSRDSSGHHLL | 606 |
| BCMA_EBB-C1978-A4 | RASQSVSSAYLA | 527 | GASTRAT | 567 | QHYGSSFNGSSLFT | 607 |
| BCMA_EBB-C1978-G1 | RASQSVSNSLA | 528 | DASSRAT | 568 | QQFGTSSGLT | 608 |
| BCMA_EBB-C1979-C1 | RASQSVSSSFLA | 529 | GASSRAT | 569 | QQYHSSPSWT | 609 |
| BCMA_EBB-C1978-C7 | RASQSVSTTFLA | 530 | GSSNRAT | 570 | QQYHSSPSWT | 610 |
| BCMA_EBB-C1978-D10 | RASQSISSYLN | 531 | AASSLQS | 571 | QQSYSTPYS | 611 |
| BCMA_EBB-C1979-C12 | RATQSIGSSFLA | 532 | GASQRAT | 572 | QHYESSPSWT | 612 |
| BCMA_EBB-C1980-G4 | RASQSVSSSYLA | 533 | GASSRAT | 573 | QQYGSPPRFT | 613 |
| BCMA_EBB-C1980-D2 | RASQSVSSSYLA | 534 | GASSRAT | 574 | QHYGSSPSWT | 614 |
| BCMA_EBB-C1978-A10 | RASQRVASNYLA | 535 | GASSRAT | 575 | QHYDSSPSWT | 615 |
| BCMA_EBB-C1978-D4 | RASQSLSSNFLA | 536 | GASNWAT | 576 | QYYGTSPMYT | 616 |
| BCMA_EBB-C1980-A2 | RSSQSLLHSNGYNYLD | 537 | LGSNRAS | 577 | MQALQTPLT | 617 |
| BCMA_EBB-C1981-C3 | RASQSVSSSYLA | 538 | GTSSRAT | 578 | QHYGNSPPKFT | 618 |
| BCMA_EBB-C1978-G4 | RASQSVASSFLA | 539 | GASGRAT | 579 | QHYGGSPRLT | 619 |
| A7D12.2 | RASQDVNTAVS | 540 | SASYRYT | 580 | QQHYSTPWT | 620 |
| C11D5.3 | RASESVSVIGAHLIH | 541 | LASNLET | 581 | LQSRIFPRT | 621 |
| C12A3.2 | RASESVTILGSHLIY | 542 | LASNVQT | 582 | LQSRTIPRT | 622 |
| C13F12.1 | RASESVTILGSHLIY | 543 | LASNVQT | 583 | LQSRTIPRT | 623 |

CD20 CAR and CD20-Binding Sequences

In some embodiments, the CAR-expressing cell described herein is a CD20 CAR-expressing cell (e.g., a cell expressing a CAR that binds to human CD20). In some embodiments, the CD20 CAR-expressing cell includes an antigen binding domain according to WO2016/164731 and PCT/US2017/055627, incorporated herein by reference. Exemplary CD20-binding sequences or CD20 CAR sequences are disclosed in, e.g., Tables 1-5 of PCT/US2017/055627. In some embodiments, the CD20-binding sequences or CD20 CAR comprises a CDR, variable region, scFv, or full-length sequence of a CD20 CAR disclosed in PCT/US2017/055627 or WO2016/164731.

CD22 CAR and CD22-Binding Sequences

In some embodiments, the CAR-expressing cell described herein is a CD22 CAR-expressing cell (e.g., a cell expressing a CAR that binds to human CD22). In some embodiments, the CD22 CAR-expressing cell includes an antigen binding domain according to WO2016/164731 and PCT/US2017/055627, incorporated herein by reference. Exemplary CD22-binding sequences or CD22 CAR sequences are disclosed in, e.g., Tables 6A, 6B, 7A, 7B, 7C, 8A, 8B, 9A, 9B, 10A, and 10B of WO2016/164731 and Tables 6-10 of PCT/US2017/055627. In some embodiments, the CD22-binding sequences or CD22 CAR sequences comprise a CDR, variable region, scFv or full-length sequence of a CD22 CAR disclosed in PCT/US2017/055627 or WO2016/164731.

EGFR CAR and EGFR-Binding Sequences

In some embodiments, the CAR-expressing cell described herein is an EGFR CAR-expressing cell (e.g., a cell expressing a CAR that binds to human EGFR). In some embodiments, the CAR-expressing cell described herein is an EGFRvIII CAR-expressing cell (e.g., a cell expressing a CAR that binds to human EGFRvIII). Exemplary EGFRvIII CARs can include sequences disclosed in WO2014/130657, e.g., Table 2 of WO2014/130657, incorporated herein by reference.

Exemplary EGFRvIII-binding sequences or EGFR CAR sequences may comprise a CDR, a variable region, an scFv, or a full-length CAR sequence of a sequence disclosed in Table 9 (or a sequence at least about 85%, 90%, 95%, 99% or more identical thereto, and/or having one, two, three or more substitutions, insertions, deletions, or modifications).

TABLE 9

Humanized EGFRvIII CAR Constructs

| Name | SEQ ID NO: | Sequence |
|---|---|---|
| | | CAR 1 |
| CAR1 scFv domain | SEQ ID NO: 38 | eiqlvqsgaevkkpgatvkisckgsgfniedyyihwvqqapgkglewmgridpendetkygpifqgrvtita<br>dtstntvymelsslrsedtavyycafrggvywgqgttvtvssggggsggggsggggsggggsdvvmtqspd<br>slavslgeratinckssqslldsdgktylnwlqqkpgqppkrlislvskldsgvpdrfsgsgsgtdftltisslqaed<br>vavyycwqgthfpgtfgggtkveik |
| CAR1 scFv domain nt | SEQ ID NO: 652 | gaaatccagctggtccaatcgggagctgaggtcaagaagccgggagccaccgtcaagatctcatgcaaggggt<br>cgggattcaacatcgaggactactacattcactgggtgcagcaagctccgggaaaaggcctggaatggatgggc<br>agaatcgacccagaaaacgacgaaactaagtacggaccgattttccaaggaagagtgactatcaccgccgatact<br>tcaaccaataccgtctacatggaactgagctcgctccggtccgaagatactgcagtgtattactgtgcctttcgcgga<br>ggggtgtactggggccaaggaactactgtcactgtctcgtcaggaggcggagggtcgggaggaggcgggagc<br>ggaggcggtggctcgggtggcggaggaagcgacgtggtgatgacccagtccccggactccctcgccgtgagc<br>ctcggagagagggcgactatcaattgcaagtcgtcccagtcacttctggattccgatggtaaaacgtacctcaactg<br>gctgcagcaaaagccagggcagccacccaaacggttgatctcccttgtgtccaaactggatagcggagtgcctga<br>ccgcttctcgggttccggtagcgggaccgacttcaccctgacgatcagctcactgcaggcggaggacgtggcag<br>tgtactactgctggcagggaacccacttccctggcacctttggaggtggcaccaaggtggagatcaag |
| CAR1 Soluble scFv-nt | SEQ ID NO: 654 | atggccctccctgtcaccgccctgctgcttccgctggctcttctgctccacgccgctcggcccgaaatccagctggt<br>ccaatcgggagctgaggtcaagaagccgggagccaccgtcaagatctcatgcaaggggtcgggattcaacatc<br>gaggactactacattcactgggtgcagcaagctccgggaaaaggcctggaatggatgggcagaatcgacccag<br>aaaacgacgaaactaagtacggaccgattttccaaggaagagtgactatcaccgccgatacttcaaccaataccgt<br>ctacatggaactgagctcgctccggtccgaagatactgcagtgtattactgtgcctttcgcggaggggtgtactggg<br>gccaaggaactactgtcactgtctcgtcaggaggcggagggtcgggaggaggcgggagcggaggcggtggct<br>cgggtggcggaggaagcgacgtggtgatgacccagtccccggactccctcgccgtgagcctcggagagaggg<br>cgactatcaattgcaagtcgtcccagtcacttctggattccgatggtaaaacgtacctcaactggctgcagcaaaag<br>ccagggcagccacccaaacggttgatctcccttgtgtccaaactggatagcggagtgcctgaccgcttctcgggtt<br>ccggtagcgggaccgacttcaccctgacgatcagctcactgcaggcggaggacgtggcagtgtactactgctgg<br>cagggaacccacttccctggcacctttggaggtggcaccaaggtggagatcaagggatcgcaccaccatcacca<br>tcatcatcac |
| CAR1 Soluble scFv-aa | SEQ ID NO: 656 | Malpvtalllplalllhaarpeiqlvqsgaevkkpgatvkisckgsgfniedyyihwvqqapgkglewmgrid<br>pendetkygpifqgrvtitadtstntvymelsslrsedtavyycafrggvywgqgttvtvssggggsggggsgg<br>ggsggggsdvvmtqspdslavslgeratinckssqslldsdgktylnwlqqkpgqppkrlislvskldsgvpdr<br>fsgsgsgtdftltisslqaedvavyycwqgthfpgtfgggtkveikgshhhhhhhh |
| CAR 1-Full-nt lentivirus | SEQ ID NO: 658 | atggccctccctgtcaccgccctgctgcttccgctggctcttctgctccacgccgctcggcccgagatccagctggt<br>gcagtcgggagctgaagtcaaaaagcctggcgcaaccgtcaagatctcgtgcaaaggatcagggttcaacatcg<br>aggactactacatccattgggtgcaacaggcacccggaaaaggcctggagtggatggggaggattgacccaga<br>aaatgacgaaaccaagtacggaccgatcttccaaggacgggtgaccatcacggctgacacttccactaacaccgt<br>ctacatggaactctcgagccttcgctcggaagataccgcggtgtactactgcgcctttagaggtggagtctactggg<br>gacaagggactaccgtcaccgtgtcgtcaggtggcggaggatcaggcggaggcggctccggtggaggaggaa<br>gcggaggaggtggctccgacgtggtgatgacgcagtcaccggactccttggcggtgagcctgggtgaacgcgc<br>cactatcaactgcaagagctcccagagcttgctggactccgatggaaagacttatctcaattggctgcaacagaag<br>cctggccagccgccaaagagactcatctcactggtgagcaagctggatagcggagtgccagatcggttttcggga<br>tcgggctcaggcaccgacttcaccctgactatttcctccctccaagccgaggatgtggccgtctactactgttggca<br>ggggactcacttcccggggaccttcggtggaggcactaaggtggagatcaaaaccactaccccagcaccgagg |

TABLE 9-continued

| Humanized EGFRvIII CAR Constructs | | |
|---|---|---|
| Name | SEQ ID NO: | Sequence |
| | | ccacccaccccggctcctaccatcgcctcccagcctctgtccctgcgtccggaggcatgtagacccgcagctggt ggggccgtgcatacccggggtcttgacttcgcctgcgatatctacatttgggcccctctggctggtacttgcggggt cctgctgctttcactcgtgatcactctttactgtaagcgcggtcggaagaagctgctgtacatctttaagcaacccttc atgaggcctgtgcagactactcaagaggaggacggctgttcatgccggttcccagaggaggaggaaggcggct gcgaactgcgcgtgaaattcagccgcagcgcagatgctccagcctacaagcaggggcagaaccagctctacaa cgaactcaatcttggtcggagagaggagtacgacgtgctggacaagcggagaggacgggacccagaaatggg cgggaagccgcgcagaaagaatccccaagagggcctgtacaacgagctccaaaaggataagatggcagaagc ctatagcgagattggtatgaaaggggaacgcagaagaggcaaaggccacgacggactgtaccagggactcagc accgccaccaaggacacctatgacgctcttcacatgcaggccctgccgcctcgg |
| CAR 1-Full-aa | SEQ ID NO: 660 | malpvtalllplalllhaarpeiqlvqsgaevkkpgatvkisckgsgfnie**dyyih**wvqqapgkglewmg**ri dpendetkygpifqg**rvtitadtstntvymelsslrsedtavyycafrggvywgqgttvtvssggggsggggs ggggsggggsdvvmtqspdslavslgeratinc**kssqsllldsdgktyln**wlqqkpgqppkrlis**lvsklds**g vpdrfsgsgsgtdftltisslqaedvavyyc**wqgthfpgt**fgggtkveikttpaprpptpaptiasqplslrpea crpaaggavhtrgldfacdiyiwaplagtcgvlllslvitlyckrgrkkllyifkqpfmrpvqttqeedgcscrfpe eeeggcelrvkfsrsadapaykqgqnqlynelnlgrreeydvldkrrgrdpemggkprrknpqeglynelqk dkmaeayseigmkgerrrgkghdglyqglstatkdtydalhmqalppr |
| CAR 2 | | |
| CAR2 scFv domain | SEQ ID NO: 662 | dvvmtqspdslavslgeratinckssqslldsdgktylnwlqqkpgqppkrlislvskldsgvpdrfsgsgsgtd ftltisslqaedvavyycwqgthfpgtfgggtkveikggggsggggsggggsggggseiqlvqsgaevkkpg atvkisckgsgfniedyyihwvqqapgkglewmgridpendetkygpifqgrvtitadtstntvymelsslrs edtavyycafrggvywgqgttvtvss |
| CAR2 scFv domain-nt | SEQ ID NO: 664 | gatgtcgtgatgacccagtccccagactccctcgcagtgtccttgggagaacgggccaccatcaactgcaaatcg agccagtcactgctggactcagacggaaagacctacctcaactggctgcagcagaagcctggccagccaccga agcgcctgatctccctggtgtccaagctggactcgggcgtcccggacaggtttagcggtagcggctcgggaacc gacttcactctgaccattagctcgctccaagctgaagatgtggcggtctactactgctggcaggggacccacttccc cgggacctttggcggaggaactaaagtcgaaatcaaaggaggaggcggatcaggtggaggaggcagcggag gaggagggagcggcggtggcggctccgaaattcaacttgtgcaatccggtgccgaggtgaagaaacctggtgc cactgtcaagatctcgtgtaagggatcgggattcaatatcgaggactactacatccactgggtgcaacaggcgcca ggaaagggattggagtggatgggtcgcatcgacccggaaaacgatgagactaagtacggaccgatcttccaagg ccgggtcacgatcactgcggatacctccactaataccgtgtatatggagctctcgtcactgagaagcgaagatacg gccgtgtactactgcgcattcagaggaggtgtgtactggggccagggaactactgtgaccgtgtcgtcg |
| CAR2-Soluble scFv-nt | SEQ ID NO: 666 | atggccctccctgtcaccgccctgctgcttccgctggctcttctgctccacgccgctcggcccgatgtcgtgatgac ccagtccccagactccctcgcagtgtccttgggagaacgggccaccatcaactgcaaatcgagccagtcactgct ggactcagacggaaagacctacctcaactggctgcagcagaagcctggccagccaccgaagcgcctgatctcc ctggtgtccaagctggactcgggcgtcccggacaggtttagcggtagcggctcgggaaccgacttcactctgacc attagctcgctccaagctgaagatgtggcggtctactactgctggcaggggacccacttccccgggacctttggcg gaggaactaaagtcgaaatcaaaggaggaggcggatcaggtggaggaggcagcggaggaggagggagcgg cggtggcggctccgaaattcaacttgtgcaatccggtgccgaggtgaagaaacctggtgccactgtcaagatctc gtgtaagggatcgggattcaatatcgaggactactacatccactgggtgcaacaggcgccaggaaagggattgg agtggatgggtcgcatcgacccggaaaacgatgagactaagtacggaccgatcttccaaggccgggtcacgatc actgcggatacctccactaataccgtgtatatggagctctcgtcactgagaagcgaagatacggccgtgtactactg cgcattcagaggaggtgtgtactggggccagggaactactgtgaccgtgtcgtcggggtcacatcaccaccatca tcatcaccac |

TABLE 9-continued

Humanized EGFRvIII CAR Constructs

| Name | SEQ ID NO: | Sequence |
|---|---|---|
| CAR2-<br>Soluble scFv-<br>aa | SEQ ID NO:<br>668 | malpvtalllplalllhaarpdvvmtqspdslavslgeratinckssqslldsdgktylnwlqqkpgqppkrlisl<br>vskldsgvpdrfsgsgsgtdftltisslqaedvavyycwqgthfpgtfgggtkveikggggsggggsggggsg<br>gggseiqlvqsgaevkkpgatvkisckgsgfniedyyihwvqqapgkglewmgridpendetkygpifqgr<br>vtitadtstntvymelsslrsedtavyycafrggvywgqgttvtvssgshhhhhhhh |
| CAR 2-Full-<br>nt | SEQ ID NO:<br>669 | atggccctccctgtcaccgccctgctgcttccgctggctcttctgctccacgccgctcggcccgacgtggtcatgac<br>tcaaagcccagattccttggctgtctcccttggagaaagagcaacgatcaattgcaaaagctcgcagtccctgttgg<br>actccgatggaaaaacctacctcaactggctgcagcagaagccgggacaaccaccaaagcggctgatttccctc<br>gtgtccaagctggacagcggcgtgccggatcgcttctcgggcagcggctcgggaaccgattttactctcactatttc<br>gtcactgcaagcggaggacgtggcggtgtattactgctggcagggcactcacttcccgggtacttttggtggaggt<br>accaaagtcgaaatcaagggtggaggcgggagcggaggaggcgggtcgggaggaggaggatcgggtggcg<br>gaggctcagaaatccagctggtgcagtcaggtgccgaagtgaagaagcctggggccacggtgaagatctcgtg<br>caaggggagcggattcaacatcgaggattactacatccattgggtgcaacaggcccctggcaaagggctggaat<br>ggatgggaaggatcgaccccgagaatgacgagactaagtacggcccgatcttccaaggacgggtgaccatcact<br>gcagacacttcaaccaacaccgtctacatggaactctcctcgctgcgctccgaggacaccgccgtgtactactgtg<br>ctttcagaggaggagtctactggggacagggaacgaccgtgaccgtcagctcaaccactaccccagcaccgag<br>gccacccaccccggctcctaccatcgcctcccagcctctgtccctgcgtccggaggcatgtagacccgcagctgg<br>tggggccgtgcatacccggggtcttgacttcgcctgcgatatctacatttgggcccctctggctggtacttgcgggg<br>tcctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR 2-Full-<br>aa | SEQ ID NO:<br>671 | malpvtalllplalllhaarpdvvmtqspdslavslgeratinc**kssqslldsdgktyln**wlqqkpgqppkrlis<br>lvskldsgvpdrfsgsgsgtdftltisslqaedvavyyc**wqgthfpgt**fgggtkveikggggsggggsggggs<br>ggggseiqlvqsgaevkkpgatvkisckgsgfnie**dyyih**wvqqapgkglewmg**ridpendetkygpif**<br>**qg**rvtitadtstntvymelsslisedtavyyca**frggvy**wgqgttvtvsstapaprpptpaptiasqplslrpeac<br>rpaaggavhtrgldfacdiyiwaplagtcgvlllslvitlyckrgrkkllyifkqpfmrpvqttqeedgcscrfpee<br>eeggcelrvkfsrsadapaykqgqnqlynelnlgrreeydvldkrrgrdpemggkprrknpqeglynelqkd<br>kmaeayseigmkgerrrgkghdglyqglstatkdtydalhmqalppr |
| | | CAR 3 |
| CAR3 scFv<br>domain | SEQ ID NO:<br>674 | eiqlvqsgaevkkpgeslrisckgsgfniedyyihwvrqmpgkglewmgridpendetkygpifqghvtis<br>adtsintvylqwsslkasdtamyycafrggvywgqgttvtvssggggsggggsggggsggggsdvvmtqs<br>plslpvtlgqpasisckssqslldsdgktylnwlqqrpgqsprrlislvskldsgvpdrfsgsgsgtdftlkisrvea<br>edvgvyycwqgthfpgtfgggtkveik |
| CAR3 scFv<br>domain nt | SEQ ID NO:<br>677 | gagattcagctggtccaaagcggcgcagaagtgaaaaagccaggggaatcgttgcgcatcagctgtaaaggttc<br>cggcttcaacatcgaggactattacatccattgggtgcggcagatgccaggaaaggggctggaatggatgggac<br>ggattgacccggagaacgacgaaaccaagtacggaccgatctttcaaggacacgtgactatctccgccgacacc<br>agcatcaatacggtgtacctccaatggtcctcactcaaggcctcggataccgcgatgtactactgcgcgttcagag<br>gaggcgtctactggggacaagggactactgtgactgtctcatcaggaggtggaggaagcggaggaggtggctc<br>gggcggaggtggatcgggaggaggagggtccgatgtggtgatgacccagtccccactgtcgctcccggtgacc<br>ctcggacagcctgctagcatctcgtgcaaatcctcgcaatccctgctggactcggacggaaaaacgtacctcaatt<br>ggctgcagcagcgccctggccagagcccgagaaggcttatctcgctggtgtcaaagctggatagcggtgtgccc |

TABLE 9-continued

Humanized EGFRvIII CAR Constructs

| Name | SEQ ID NO: | Sequence |
|---|---|---|
| | | gaccggttcagcggctcagggtcaggaaccgatttcaccttgaagatctcccgcgtggaagccgaagatgtcgga<br>gtctactactgctggcagggtactcacttcccggggacctttggtggcggcactaaggtcgagattaag |
| CAR 3-<br>Soluble scFv-<br>nt | SEQ ID NO:<br>680 | atggccctccctgtcaccgccctgctgcttccgctggctcttctgctccacgccgctcggcccgagattcagctggt<br>ccaaagcggcgcagaagtgaaaaagccaggggaatcgttgcgcatcagctgtaaaggttccggcttcaacatcg<br>aggactattacatccattgggtgcggcagatgccaggaaaggggctggaatggatgggacggattgacccggag<br>aacgacgaaaccaagtacggaccgatctttcaaggacacgtgactatctccgccgacaccagcatcaatacggtg<br>tacctccaatggtcctcactcaaggcctcggataccgcgatgtactactgcgcgttcagaggaggcgtctactggg<br>gacaagggactactgtgactgtctcatcaggaggtggaggaagcggaggaggtggctcgggcggaggtggatc<br>gggaggaggagggtccgatgtggtgatgacccagtccccactgtcgctcccggtgaccctcggacagcctgcta<br>gcatctcgtgcaaatcctcgcaatccctgctggactcggacggaaaaacgtacctcaattggctgcagcagcgcc<br>ctggccagagcccgagaaggcttatctcgctggtgtcaaagctggatagcggtgtgcccgaccggttcagcggct<br>cagggtcaggaaccgatttcaccttgaagatctcccgcgtggaagccgaagatgtcggagtctactactgctggca<br>gggtactcacttcccggggacctttggtggcggcactaaggtcgagattaagggctcacaccatcatcaccatcac<br>caccac |
| CAR 3-<br>Soluble scFv-<br>aa | SEQ ID NO:<br>683 | malpvtalllplalllhaarpeiqlvqsgaevkkpgeslrisckgsgfniedyyihwvrqmpgkglewmgrid<br>pendetkygpifqghvtisadtsintvylqwsslkasdtamyycafrggvywgqgttvtvssggggsggggs<br>ggggsggggsdvvmtqsplslpvtlgqpasisckssqslldsdgktylnwlqqrpgqsprrlislvskldsgvp<br>drfsgsgsgtdftlkisrveaedvgvyycwqgthfpgtfgggtkveikgshhhhhhhh |
| CAR 3-Full-<br>nt | SEQ ID NO:<br>686 | atggccctccctgtcaccgccctgctgcttccgctggctcttctgctccacgccgctcggcccgaaatccagctggt<br>gcaaagcggagccgaggtgaagaagcccggagaatccctgcgcatctcgtgtaagggttccggctttaacatcg<br>aggattactacatccactgggtgagacagatgccgggcaaaggtctggaatggatgggccgcatcgacccggag<br>aacgacgaaaccaaatacggaccaatcttccaaggacatgtgactatttccgcggatacctccatcaacactgtcta<br>cttgcagtggagctcgctcaaggcgtcggataccgccatgtactactgcgcattcagaggaggtgtgtactgggg<br>ccagggcactacggtcaccgtgtcctcgggaggtggagggtcaggaggcggaggctcgggcggtggaggatc<br>aggcggaggaggaagcgatgtggtcatgactcaatccccactgtcactgcctgtcactctggggcaaccggcttc<br>catctcatgcaagtcaagccaatcgctgctcgactccgacggaaaaacctacctcaattggcttcagcagcgccca<br>ggccagtcgcctcggaggctgatctcactcgtgtcgaagcttgactccggggtgccggatcggtttagcggaagc<br>ggatcggggaccgacttcacgttgaagattagccgggtggaagccgaggacgtgggagtctattactgctggca<br>ggggacccacttcccggggactttcggaggaggcaccaaagtcgagattaagaccactaccccagcaccgagg<br>ccacccaccccggctcctaccatcgcctcccagcctctgtccctgcgtccggaggcatgtagacccgcagctggt<br>ggggccgtgcatacccggggtcttgacttcgcctgcgatatctacatttgggcccctctggctggtacttgcggggt<br>cctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR 3-Full-<br>aa | SEQ ID NO:<br>689 | malpvtalllplalllhaarpeiqlvqsgaevkkpgeslrisckgsgfnie**dyyih**wvrqmpgkglewmg**rid**<br>**pendetkygpifqg**hvtisadtsintvylqwsslkasdtamyycaf**rggvy**wgqgttvtvssggggsgggg<br>sggggsggggsdvvmtqsplslpvtlgqpasisc**kssqslldsdgktyln**wlqqrpgqsprrlis**lvsklds**g<br>vpdrfsgsgsgtdftlkisrveaedvgvyyc**wqgthfpgt**fgggtkveiktttpaprpptpaptiasqplslrpe<br>acrpaaggavhtrgldfacdiyiwaplagtcgvlllslvitlyckrgrkkllyifkqpfmrpvqttqeedgcscrfp<br>eeeeggcelrvkfsrsadapaykqgqnqlynelnlgrreeydvldlargrdpemggkprrknpqeglynelq<br>kdkmaeayseigmkgerrrgkghdglyqglstatkdtydalhmqalppr |

TABLE 9-continued

| Humanized EGFRvIII CAR Constructs | | |
|---|---|---|
| Name | SEQ ID NO: | Sequence |
| | | CAR 4 |
| CAR4 scFv domain | SEQ ID NO: 692 | dvvmtqsplslpvtlgqpasisckssqslldsdgktylnwlqqrpgqsprrlislvskldsgvpdrfsgsgsgtdf<br>tlkisrveaedvgvyycwqgthfpgtfgggtkveikggggsggggsggggsggggseiqlvqsgaevkkpg<br>eslrisckgsgfniedyyihwvrqmpgkglewmgridpendetkygpifqghvtisadtsintvylqwsslka<br>sdtamyycafrggvywgqgttvtvss |
| CAR4 scFv domain nt | SEQ ID NO: 695 | gacgtcgtcatgacccagagcccgctgtcactgcctgtgaccctgggccagccggcgtccattagctgcaaatcc<br>tcgcaatccctgctcgactcagacggaaaaacgtacttgaactggctccaacagcgccctgggcaatccccaagg<br>cggcttatctcactcgtcagcaagctcgatagcggtgtcccagacagattttcgggctcgggatcgggcactgattt<br>cactctgaagatctcgcgggtggaagccgaggatgtgggagtgtactattgctggcagggcactcacttccccgg<br>gacgtttggcggaggaactaaggtcgagatcaaaggaggaggtggatcaggcggaggtgggagcggaggag<br>gaggaagcggtggtggaggttccgaaatccagctggtgcaatcaggagccgaggtgaagaagccgggagaat<br>ccctgcgcatctcgtgcaagggctcgggcttcaacatcgaggattactacatccactgggtgcggcagatgccgg<br>gaaaggggttggaatggatgggacgcattgacccggaaaatgatgaaaccaaatacgggccaatcttccaaggc<br>cacgtgaccattagcgctgacacttccatcaacaccgtgtaccttcagtggtcctcactgaaggcgtcggacactgc<br>catgtactactgtgcattcagaggaggggtctactggggacagggcaccaccgtgaccgtgagctcc |
| CAR4-Soluble scFv-nt | SEQ ID NO: 698 | atggccctccctgtcaccgccctgctgcttccgctggctcttctgctccacgccgctcggcccgacgtcgtcatgac<br>ccagagcccgctgtcactgcctgtgaccctgggccagccggcgtccattagctgcaaatcctcgcaatccctgctc<br>gactcagacggaaaaacgtacttgaactggctccaacagcgccctgggcaatccccaaggcggcttatctcactc<br>gtcagcaagctcgatagcggtgtcccagacagattttcgggctcgggatcgggcactgatttcactctgaagatctc<br>gcgggtggaagccgaggatgtgggagtgtactattgctggcagggcactcacttccccgggacgtttggcggag<br>gaactaaggtcgagatcaaaggaggaggtggatcaggcggaggtgggagcggaggaggaggaagcggtggt<br>ggaggttccgaaatccagctggtgcaatcaggagccgaggtgaagaagccgggagaatccctgcgcatctcgtg<br>caagggctcgggcttcaacatcgaggattactacatccactgggtgcggcagatgccgggaaaggggttggaat<br>ggatgggacgcattgacccggaaaatgatgaaaccaaatacgggccaatcttccaaggccacgtgaccattagc<br>gctgacacttccatcaacaccgtgtaccttcagtggtcctcactgaaggcgtcggacactgccatgtactactgtgc<br>attcagaggaggggtctactggggacagggcaccaccgtgaccgtgagctccggctcgcatcaccatcatcacc<br>accatcac |
| CAR4-Soluble scFv-aa | SEQ ID NO: 700 | malpvtalllplalllhaarpdvvmtqsplslpvtlgqpasisckssqslldsdgktylnwlqqrpgqsprrlislv<br>skldsgvpdrfsgsgsgtdftlkisrveaedvgvyycwqgthfpgtfgggtkveikggggsggggsggggsg<br>gggseiqlvqsgaevkkpgeslrisckgsgfniedyyihwvrqmpgkglewmgridpendetkygpifqg<br>hvtisadtsintvylqwsslkasdtamyycafrggvywgqgttvtvssgshhhhhhhh |
| CAR 4-Full-nt | SEQ ID NO: 702 | atggccctccctgtcaccgccctgctgcttccgctggctcttctgctccacgccgctcggcccgacgtcgtcatgac<br>ccaatcccctctctccctgccggtcaccctgggtcagccggcgtcgatctcatgcaaaagctcacagtccctgctg<br>gattcggacggaaaaacctacttgaactggctccaacagaggccgggtcagtcccctcgcagactgatctcgctg<br>gtgagcaagctcgactcgggtgtgccggatcggttctccgggtcaggatcgggcaccgactttacgctcaagattt<br>cgagagtggaggccgaggatgtgggagtgtactattgctggcagggcacgcatttccccgggacctttggaggc<br>gggactaaggtggaaatcaagggaggtggcggatcaggcggaggaggcagcggcggaggtggatcaggag<br>gcggagggtcagagatccagctggtccaaagcggagcagaggtgaagaagccaggcgagtcccttcgcatttc<br>gtgcaaaggagcggcttcaacattgaagattactacatccactgggtgcggcaaatgccaggaaagggtctgga<br>atggatgggacggatcgacccagaaaatgatgaaactaagtacggaccgatcttccaaggacacgtcactatctc<br>cgcggacacttcgatcaacaccgtgtacctccagtggagcagcttgaaagcctccgacaccgctatgtactactgt<br>gccttccgcggaggagtctactggggacaggggactactgtgaccgtgtcgtccaccactaccccagcaccgag<br>gccacccaccccggctcctaccatcgcctcccagcctctgtccctgcgtccggaggcatgtagacccgcagctgg |

TABLE 9-continued

Humanized EGFRvIII CAR Constructs

| Name | SEQ ID NO: | Sequence |
|---|---|---|
| | | tggggccgtgcatacccggggtcttgacttcgcctgcgatatctacatttgggcccctctggctggtacttgcgggg<br>tcctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR-Full-<br>aa | SEQ ID NO:<br>704 | malpvtalllplalllhaarpdvvmtqsplslpvtlgqpasisc**kssqslldsdgktyln**wlqqrpgqsprrlis**l**<br>**vsklds**gvpdrfsgsgsgtdftlkisrveaedvgvyyc**wqgthfpgt**fgggtkveikggggsggggsggggs<br>ggggseiqlvqsgaevkkpgeslrisckgsgfnie**dyyih**wvrqmpgkglewmg**ridpendetkygpif**<br>**qg**hvtisadtsintvylqwsslkasdtamyycaf**rggvy**wgqgttvtvsstapaprpptpaptiasqplslrpe<br>acrpaaggavhtrgldfacdiyiwaplagtcgvlllslvitlyckrgrkkllyifkqpfmrpvqttqeedgcscrfp<br>eeeeggcelrvkfsrsadapaykqgqnqlynelnlgrreeydvldlargrdpemggkprrknpqeglynelq<br>kdkmaeayseigmkgerrrgkghdglyqglstatkdtydalhmqalppr |
| | | CAR 5 |
| CAR5 scFv<br>domain | SEQ ID NO:<br>706 | eiqlvqsgaevkkpgatvkisckgsgfniedyyihwvqqapgkglewmgridpendetkygpifqgrvtita<br>dtstntvymelsslrsedtavyycafrggvywgqgttvtvssggggsggggsggggsggggsdvvmtqspls<br>lpvtlgqpasisckssqslldsdgktylnwlqqrpgqsprrlislvskldsgvpdrfsgsgsgtdftlkisrveaed<br>vgvyycwqgthfpgtfgggtkveik |
| CAR5 scFv<br>domain nt | SEQ ID NO:<br>708 | gaaatccagctcgtgcagagcggagccgaggtcaagaaaccgggtgctaccgtgaagatttcatgcaagggatc<br>gggcttcaacatcgaggattactacatccactgggtgcagcaggcaccaggaaaaggacttgaatggatgggcc<br>ggatcgacccggaaaatgacgagactaagtacggccctatcttccaaggacgggtgacgatcaccgcagacact<br>agcaccaacaccgtctatatggaactctcgtccctgaggtccgaagatactgccgtgtactactgtgcgtttcgcgg<br>aggtgtgtactggggacagggtaccaccgtcaccgtgtcatcgggcggtggaggctccggtggaggagggtca<br>ggaggcggtggaagcggaggaggcggcagcgacgtggtcatgactcaatcgccgctgtcgctgcccgtcactc<br>tgggacaacccgcgtccatcagctgcaaatcctcgcagtcactgcttgactccgatggaaagacctacctcaactg<br>gctgcagcaacgcccaggccaatccccaagacgcctgatctcgttggtgtcaaagctggactcaggggtgccgg<br>accggttctccgggagcgggtcgggcacggatttcactctcaagatctccagagtggaagccgaggatgtggga<br>gtctactactgctggcagggaacccatttccctggaacttttggcggaggaactaaggtcgagattaaa |
| CAR5-<br>Soluble scFv-<br>nt | SEQ ID NO:<br>710 | atggccctccctgtcaccgccctgctgcttccgctggctcttctgctccacgccgctcggcccgaaatccagctcgt<br>gcagagcggagccgaggtcaagaaaccgggtgctaccgtgaagatttcatgcaagggatcgggcttcaacatcg<br>aggattactacatccactgggtgcagcaggcaccaggaaaaggacttgaatggatgggccggatcgacccgga<br>aaatgacgagactaagtacggccctatcttccaaggacgggtgacgatcaccgcagacactagcaccaacaccg<br>tctatatggaactctcgtccctgaggtccgaagatactgccgtgtactactgtgcgtttcgcggaggtgtgtactggg<br>gacagggtaccaccgtcaccgtgtcatcgggcggtggaggctccggtggaggagggtcaggaggcggtggaa<br>gcggaggaggcggcagcgacgtggtcatgactcaatcgccgctgtcgctgcccgtcactctgggacaacccgc<br>gtccatcagctgcaaatcctcgcagtcactgcttgactccgatggaaagacctacctcaactggctgcagcaacgc<br>ccaggccaatccccaagacgcctgatctcgttggtgtcaaagctggactcaggggtgccggaccggttctccggg<br>agcgggtcgggcacggatttcactctcaagatctccagagtggaagccgaggatgtgggagtctactactgctgg<br>cagggaacccatttccctggaacttttggcggaggaactaaggtcgagattaaaggagccaccatcatcatcacc<br>accaccac |

TABLE 9-continued

| Humanized EGFRvIII CAR Constructs | | |
|---|---|---|
| Name | SEQ ID NO: | Sequence |
| CAR5-<br>Soluble scFv-<br>aa | SEQ ID NO:<br>712 | malpvtalllplalllhaarpeiqlvqsgaevkkpgatvkisckgsgfniedyyihwvqqapgkglewmgrid<br>pendetkygpifqgrvtitadtstntvymelsslrsedtavyycafrggvywgqgttvtvssggggsggggsgg<br>ggsggggsdvvmtqsplslpvtlgqpasisckssqslldsdgktylnwlqqrpgqsprrlislvskldsgvpdrf<br>sgsgsgtdftlkisrveaedvgvyycwqgthfpgtfgggtkveikgshhhhhhhh |
| CAR5-Full-<br>nt | SEQ ID NO:<br>714 | atggccctccctgtcaccgccctgctgcttccgctggctcttctgctccacgccgctcggcccgaaatccagctcgt<br>gcagagcggagccgaggtcaagaaaccgggtgctaccgtgaagatttcatgcaagggatcgggcttcaacatcg<br>aggattactacatccactgggtgcagcaggcaccaggaaaaggacttgaatggatgggccggatcgacccgga<br>aaatgacgagactaagtacggccctatcttccaaggacgggtgacgatcaccgcagacactagcaccaacaccg<br>tctatatggaactctcgtccctgaggtccgaagatactgccgtgtactactgtgcgtttcgcggaggtgtgtactggg<br>gacagggtaccaccgtcaccgtgtcatcgggcggtggaggctccggtggaggagggtcaggaggcggtggaa<br>gcggaggaggcggcagcgacgtggtcatgactcaatcgccgctgtcgctgcccgtcactctgggacaacccgc<br>gtccatcagctgcaaatcctcgcagtcactgcttgactccgatggaaagacctacctcaactggctgcagcaacgc<br>ccaggccaatccccaagacgcctgatctcgttggtgtcaaagctggactcaggggtgccggaccggttctccggg<br>agcgggtcgggcacggatttcactctcaagatctccagagtggaagccgaggatgtgggagtctactactgctgg<br>cagggaacccatttccctggaacttttggcggaggaactaaggtcgagattaaaaccactaccccagcaccgagg<br>ccacccaccccggctcctaccatcgcctcccagcctctgtccctgcgtccggaggcatgtagacccgcagctggt<br>ggggccgtgcatacccggggtcttgacttcgcctgcgatatctacatttgggcccctctggctggtacttgcggggt<br>cctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR5-Full-<br>aa | SEQ ID NO:<br>716 | malpvtalllplalllhaarpeiqlvqsgaevkkpgatvkisckgsgfnie**dyyih**wvqqapgkglewmg**ri**<br>**dpendetkygpifqg**rvtitadtstntvymelsslrsedtavyycaf**rggvy**wgqgttvtvssggggsggggs<br>ggggsggggsdvvmtqsplslpvtlgqpasisc**kssqslldsdgktyln**wlqqrpgqsprrlis**lvsklds**gv<br>pdrfsgsgsgtdftlkisrveaedvgvyyc**wqgthfpgt**fgggtkveikttpaprpptpaptiasqplslrpeac<br>rpaaggavhtrgldfacdiyiwaplagtcgvlllslvitlyckrgrkkllyifkqpfmrpvqttqeedgcscrfpee<br>eeggcelrvkfsrsadapaykqgqnqlynelnlgrreeydvldkrrgrdpemggkprrknpqeglynelqkd<br>kmaeayseigmkgerrrgkghdglyqglstatkdtydalhmqalppr |
| CAR 6 | | |
| CAR6<br>scFv domain | SEQ ID NO:<br>718 | eiqlvqsgaevkkpgeslrisckgsgfniedyyihwvrqmpgkglewmgridpendetkygpifqghvtis<br>adtsintvylqwsslkasdtamyycafrggvywgqgttvtvssggggsggggsggggsggggsdvvmtqs<br>pdslavslgeratinckssqslldsdgktylnwlqqkpgqppkrlislvskldsgvpdrfsgsgsgtdftltisslqa<br>edvavyycwqgthfpgtfgggtkveik |
| CAR6 scFv<br>domain nt | SEQ ID NO:<br>720 | gaaatccagctggtgcagtcaggcgccgaggtcaagaagccgggagagtcgctgagaatctcgtgcaagggct<br>cggggttcaacatcgaggactactacattcactgggtcaggcagatgccgggaaagggactggaatggatgggc<br>cggatcgacccagaaaatgacgaaaccaaatacgggccgatttttcaaggccacgtgactatcagcgcagacac<br>gagcatcaacactgtctacctccagtggtcctcgcttaaggccagcgataccgctatgtactactgcgcattcagag<br>gcggggtgtactggggacaaggaaccactgtgaccgtgagcagcggaggtggcggctcgggaggaggtggg<br>agcggaggaggaggttccggcggtggaggatcagatgtcgtgatgacccagtccccggactccctcgctgtctc<br>actgggcgagcgcgcgaccatcaactgcaaatcgagccagtcgctgttggactccgatggaaagacttatctgaa<br>ttggctgcaacagaaaccaggacaacctcccaagcggctcatctcgcttgtgtcaaaactcgattcgggagtgcca |

TABLE 9-continued

| Humanized EGFRvIII CAR Constructs | | |
|---|---|---|
| Name | SEQ ID NO: | Sequence |
| | | gaccgcttctcggggtccgggagcggaactgactttactttgaccatttcctcactgcaagcggaggatgtggccg<br>tgtattactgttggcagggcacgcatttccctggaaccttcggtggcggaactaaggtggaaatcaag |
| CAR6-<br>Soluble scFv-<br>nt | SEQ ID NO:<br>722 | atggccctccctgtcaccgccctgctgcttccgctggctcttctgctccacgccgctcggcccgaaatccagctggt<br>gcagtcaggcgccgaggtcaagaagccgggagagtcgctgagaatctcgtgcaagggctcggggttcaacatc<br>gaggactactacattcactgggtcaggcagatgccgggaaagggactggaatggatgggccggatcgacccag<br>aaaatgacgaaaccaaatacgggccgatttttcaaggccacgtgactatcagcgcagacacgagcatcaacactg<br>tctacctccagtggtcctcgcttaaggccagcgataccgctatgtactactgcgcattcagaggcggggtgtactgg<br>ggacaaggaaccactgtgaccgtgagcagcggaggtggcggctcgggaggaggtgggagcggaggaggag<br>gttccggcggtggaggatcagatgtcgtgatgacccagtccccggactccctcgctgtctcactgggcgagcgcg<br>cgaccatcaactgcaaatcgagccagtcgctgttggactccgatggaaagacttatctgaattggctgcaacagaa<br>accaggacaacctcccaagcggctcatctcgcttgtgtcaaaactcgattcgggagtgccagaccgcttctcggg<br>gtccgggagcggaactgactttactttgaccatttcctcactgcaagcggaggatgtggccgtgtattactgttggca<br>gggcacgcatttccctggaaccttcggtggcggaactaaggtggaaatcaagggatcacaccaccatcatcacca<br>tcaccaccat |
| CAR6-<br>Soluble scFv-<br>aa | SEQ ID NO:<br>724 | malpvtalllplalllhaarpeiqlvqsgaevkkpgeslrisckgsgfniedyyihwvrqmpgkglewmgrid<br>pendetkygpifqghvtisadtsintvylqwsslkasdtamyycafi-ggvywgqgfivtvssggggsggggs<br>ggggsggggsdvvmtqspdslavslgeratinckssqsllldsdgktylnwlqqkpgqppkrlislvskldsgv<br>pdrfsgsgsgtdftltisslqaedvavyycwqgthfpgtfgggtkveikgshhhhhhhh |
| CAR6-<br>Full-nt | SEQ ID NO:<br>726 | atggccctccctgtcaccgccctgctgcttccgctggctcttctgctccacgccgctcggcccgagattcagctcgt<br>gcaatcgggagcggaagtcaagaagccaggagagtccttgcggatctcatgcaagggtagcggctttaacatcg<br>aggattactacatccactgggtgaggcagatgccggggaagggactcgaatggatgggacggatcgacccaga<br>aaacgacgaaactaagtacggtccgatcttccaaggccatgtgactattagcgccgatacttcaatcaataccgtgt<br>atctgcaatggtcctcattgaaagcctcagataccgcgatgtactactgtgctttcagaggaggggtctactgggga<br>cagggaactaccgtgactgtctcgtccggcggaggcgggtcaggaggtggcggcagcggaggaggagggtc<br>cggcggaggtgggtccgacgtcgtgatgacccagagccctgacagcctggcagtgagcctgggcgaaagagc<br>taccattaactgcaaatcgtcgcagagcctgctggactcggacggaaaaacgtacctcaattggctgcagcaaaa<br>gcctggccagccaccgaagcgccttatctcactggtgtcgaagctggattcgggagtgcccgatcgcttctccgg<br>ctcgggatcgggtactgacttcaccctcactatctcctcgcttcaagcagaggacgtggccgtctactactgctggc<br>agggaacccactttccgggaaccttcggcggagggacgaaagtggagatcaagaccactaccccagcaccgag<br>gccacccaccccggctcctaccatcgcctcccagcctctgtccctgcgtccggaggcatgtagacccgcagctgg<br>tggggccgtgcatacccggggtcttgacttcgcctgcgatatctacatttgggcccctctggctggtacttgcgggg<br>tcctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR6-<br>Full-aa | SEQ ID NO:<br>728 | malpvtalllplalllhaarpeiqlvqsgaevkkpgeslrisckgsgfnie**dyyih**wvrqmpgkglewmg**rid**<br>**pendetkygpifqg**hvtisadtsintvylqwsslkasdtamyycaf**rggvy**wgqgttvtvssggggsgggg<br>sggggsggggsdvvmtqspdslavslgeratinc**kssqslldsdgktyln**wlqqkpgqppkrlis**lvsklds**<br>gvpdrfsgsgsgtdftltisslqaedvavyyc**wqgthfpgt**fgggtkveikttpaprpptpaptiasqplslrpe<br>acrpaaggavhtrgldfacdiyiwaplagtcgvlllslvitlyckrgrkkllyifkqpfmrpvqttqeedgcscrfp<br>eeeeggcelrvkfsrsadapaykqgqnqlynelnlgrreeydvldlargrdpemggkprrknpqeglynelq<br>kdkmaeayseigmkgerrrgkghdglyqglstatkdtydalhmqalppr |

TABLE 9-continued

Humanized EGFRvIII CAR Constructs

| Name | SEQ ID NO: | Sequence |
|---|---|---|
| | | CAR 7 |
| CAR7 scFv domain | SEQ ID NO: 730 | dvvmtqspdslayslgeratinckssqslldsdgktylnwlqqkpgqppkrlislvskldsgvpdrfsgsgsgtd<br>ftltisslqaedvavyycwqgthfpgtfgggtkveikggggsggggsggggsggggseiqlvqsgaevkkpg<br>eslrisckgsgfniedyyihwvrqmpgkglewmgridpendetkygpifqghvtisadtsintvylqwsslka<br>sdtamyycafrggvywgqgttvtvss |
| CAR7 scFv domain nt | SEQ ID NO: 732 | gacgtggtgatgacccaatcgccagattccctggcagtgtccctgggcgaacgcgccactattaactgcaaatcgt<br>cacagtccttgcttgattccgacggaaagacctacctcaattggctccagcagaagccaggacaaccgccaaaga<br>gactgatctccctggtgtcaaagctggactcgggagtgcctgatcggttctcgggtagcgggagcggcaccgact<br>tcactctgaccatctcgtcactccaggctgaggacgtggccgtgtattactgttggcagggtactcactttccgggca<br>ctttcggaggcggcaccaaggtggagattaaaggaggaggcggaagcggaggtggaggatcgggaggtggtg<br>ggagcggcggaggagggagcgagatccagctcgtccaatcgggagcggaagtgaagaagcccggagagtca<br>cttagaatctcatgcaaggggtcgggcttcaacatcgaggattactacatccattgggtccgccagatgcctggtaa<br>aggactggaatggatggggaggattgacccggaaaacgacgaaactaagtacggaccgatctttcaagggcac<br>gtgactatctccgctgatacctcaatcaatactgtctacctccagtggtcctcgctgaaagcaagcgacaccgcgat<br>gtactactgcgccttccggggaggagtgtactggggccaaggcaccacggtcacggtcagctcc |
| CAR7-Soluble scFv-nt | SEQ ID NO: 734 | atggccctccctgtcaccgccctgctgcttccgctggctcttctgctccacgccgctcggcccgacgtggtgatgac<br>ccaatcgccagattccctggcagtgtccctgggcgaacgcgccactattaactgcaaatcgtcacagtccttgcttg<br>attccgacggaaagacctacctcaattggctccagcagaagccaggacaaccgccaaagagactgatctccctg<br>gtgtcaaagctggactcgggagtgcctgatcggttctcgggtagcgggagcggcaccgacttcactctgaccatct<br>cgtcactccaggctgaggacgtggccgtgtattactgttggcagggtactcactttccgggcactttcggaggcgg<br>caccaaggtggagattaaaggaggaggcggaagcggaggtggaggatcgggaggtggtgggagcggcgga<br>ggagggagcgagatccagctcgtccaatcgggagcggaagtgaagaagcccggagagtcacttagaatctcat<br>gcaaggggtcgggcttcaacatcgaggattactacatccattgggtccgccagatgcctggtaaaggactggaat<br>ggatggggaggattgacccggaaaacgacgaaactaagtacggaccgatctttcaagggcacgtgactatctcc<br>gctgatacctcaatcaatactgtctacctccagtggtcctcgctgaaagcaagcgacaccgcgatgtactactgcgc<br>cttccggggaggagtgtactggggccaaggcaccacggtcacggtcagctccggctcccatcaccaccaccatc<br>accatcatcac |
| CAR7-Soluble scFv-aa | SEQ ID NO: 736 | malpvtalllplalllhaarpdvvmtqspdslavslgeratinckssqslldsdgktylnwlqqkpgqppkrlisl<br>vskldsgvpdrfsgsgsgtdftltisslqaedvavyycwqgthfpgtfgggtkveikggggsggggsggggsg<br>gggseiqlvqsgaevkkpgeslrisckgsgfniedyyihwvrqmpgkglewmgridpendetkygpifqg<br>hvtisadtsintvylqwsslkasdtamyycafrggvywgqgttvtvssgshhhhhhhh |
| CAR 7 Full-nt | SEQ ID NO: 738 | atggccctccctgtcaccgccctgctgcttccgctggctcttctgctccacgccgctcggcccgacgtggtgatgac<br>tcagtcgcctgactcgctggctgtgtcccttggagagcgggccactatcaattgcaagtcatcccagtcgctgctgg<br>attccgacgggaaaacctacctcaattggctgcagcaaaaaccgggacagcctccaaagcggctcatcagcctg<br>gtgtccaagttggacagcggcgtgccagaccgcttctccggttcgggaagcggtactgatttcacgctgaccatct<br>catccctccaagcggaggatgtggcagtctactactgttggcagggcacgcattttccgggcacttttggaggagg<br>gaccaaggtcgaaatcaagggaggaggtggctcgggcggaggaggctcgggaggaggaggatcaggaggc<br>ggtggaagcgagattcaactggtccagagcggcgcagaagtcaagaagccgggtgaatcgctcagaatctcgtg<br>caaaggatcgggattcaacatcgaggactactacattcactgggtcagacaaatgccgggcaaagggctggaat<br>ggatggggaggatcgaccccgaaaacgatgaaaccaagtacggaccaatcttccaagggcacgtgaccatttcg<br>gcggacacctcaatcaacactgtgtacctccagtggagctcacttaaggccagcgataccgccatgtactattgcg<br>ctttccgcggaggggtgtactggggacagggcactactgtgaccgtgtcatccaccactaccccagcaccgagg<br>ccacccaccccggctcctaccatcgcctcccagcctctgtccctgcgtccggaggcatgtagacccgcagctggt |

TABLE 9-continued

| Name | SEQ ID NO: | Sequence |
|---|---|---|
| Humanized EGFRvIII CAR Constructs | | |
| | | ggggccgtgcatacccggggtcttgacttcgcctgcgatatctacatttgggcccctctggctggtacttgcggggt<br>cctgctgctttcactcgtgatcactctttactgtaagcgcggtcggaagaagctgctgtacatctttaagcaacccttc<br>atgaggcctgtgcagactactcaagaggaggacggctgttcatgccggttcccagaggaggaggaaggcggct<br>gcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR 7<br>Full-aa | SEQ ID NO:<br>740 | malpvtalllplalllhaarpdvvmtqspdslayslgeratinc**kssqslldsdgktyln**wlqqkpgqppkrlis<br>lvskldsgvpdrfsgsgsgtdftltisslqaedvavyyc**wqgthfpgt**fgggtkveikggggsggggsggggs<br>ggggseiqlvqsgaevkkpgeslrisckgsgfnie**dyyih**wvrqmpgkglewmg**ridpendetkvgpif**<br>**qg**hvtisadtsintvylqwsslkasdtamyycaf**rggvy**wgqgttvtvsstapaprpptpaptiasqplslrpe<br>acrpaaggavhtrgldfacdiyiwaplagtcgvllLslvitlyckrgrkkllyifkqpfmrpvqttqeedgcscrfp<br>eeeeggcelrvkfsrsadapaykqgqnqlynelnlgrreeydvldlargrdpemggkprrknpqeglynelq<br>kdkmaeayseigmkgerrrgkghdglyqglstatkdtydalhmqalppr |
| CAR 8 | | |
| CAR8 scFv<br>domain | SEQ ID NO:<br>742 | dvvmtqsplslpvtlgqpasisckssqslldsdgktylnwlqqrpgqsprrlislvskldsgvpdrfsgsgsgtdf<br>tlkisrveaedvgvyycwqgthfpgtfgggtkveikggggsggggsggggsggggseiqlvqsgaevkkpg<br>atvkisckgsgfniedyyihwvqqapgkglewmgridpendetkygpifqgrvtitadtstntvymelsslrs<br>edtavyycafrggvywgqgttvtvss |
| CAR8 scFv<br>domain nt | SEQ ID NO:<br>744 | gatgtggtcatgacgcagtcaccactgtccctccccgtgacccttggacagccagcgtcgattagctgcaagtcat<br>cccaatccctgctcgattcggatggaaagacctatctcaactggctgcagcaaagacccggtcagagccctagga<br>gactcatctcgttggtgtcaaagctggacagcggagtgccggaccggttttccggttcgggatcggggacggactt<br>cactctgaagatttcacgggtggaagctgaggatgtgggagtgtactactgctggcagggaacccatttccctggc<br>acttttggcggaggaactaaggtcgaaatcaagggaggaggtggctcgggaggaggcggatcgggcggaggc<br>gggagcggcggaggagggtccgaaatccaacttgtccagtcaggagccgaagtgaagaaaccgggagccacc<br>gtcaaaatcagctgtaagggatcgggattcaatatcgaggactactacatccactgggtgcagcaagctccgggc<br>aaaggactggagtggatggggcgcatcgacccagagaacgacgaaaccaaatacggcccgatcttccaaggg<br>cgggtgaccatcaccgcggacacctcaactaacactgtgtacatggagctgagctccctgcgctccgaagatact<br>gcagtctactactgcgccttccgcggtggtgtgtactggggacagggcaccactgtgactgtcagctcg |
| CAR8-<br>Soluble scFv-<br>nt | SEQ ID NO:<br>746 | atggccctccctgtcaccgccctgctgcttccgctggctcttctgctccacgccgctcggcccgatgtggtcatgac<br>gcagtcaccactgtccctccccgtgacccttggacagccagcgtcgattagctgcaagtcatcccaatccctgctc<br>gattcggatggaaagacctatctcaactggctgcagcaaagacccggtcagagccctaggagactcatctcgttg<br>gtgtcaaagctggacagcggagtgccggaccggttttccggttcgggatcggggacggacttcactctgaagattt<br>cacgggtggaagctgaggatgtgggagtgtactactgctggcagggaacccatttccctggcacttttggcggag<br>gaactaaggtcgaaatcaagggaggaggtggctcgggaggaggcggatcgggcggaggcgggagcggcgg<br>aggagggtccgaaatccaacttgtccagtcaggagccgaagtgaagaaaccgggagccaccgtcaaaatcagc<br>tgtaagggatcgggattcaatatcgaggactactacatccactgggtgcagcaagctccgggcaaaggactggag<br>tggatggggcgcatcgacccagagaacgacgaaaccaaatacggcccgatcttccaagggcgggtgaccatca<br>ccgcggacacctcaactaacactgtgtacatggagctgagctccctgcgctccgaagatactgcagtctactactg<br>cgccttccgcggtggtgtgtactggggacagggcaccactgtgactgtcagctcggggtcccaccatcatcacca<br>ccaccatcac |

TABLE 9-continued

| Humanized EGFRvIII CAR Constructs | | |
|---|---|---|
| Name | SEQ ID NO: | Sequence |
| CAR8-Soluble scFv-aa | SEQ ID NO: 748 | malpvtalllplalllhaarpdvvmtqsplslpvtlgqpasisckssqslldsdgktylnwlqqrpgqsprrlislv<br>skldsgvpdrfsgsgsgtdftlkisrveaedvgvyycwqgthfpgtfgggtkveikggggsggggsggggsg<br>gggseiqlvqsgaevkkpgatvkisckgsgfniedyyihwvqqapgkglewmgridpendetkygpifqgr<br>vtitadtstntvvmelsslrsedtavyycafrggvywgqgttvtvssgshhhhhhhh |
| CAR 8-Full-nt | SEQ ID NO: 750 | atggccctccctgtcaccgccctgctgcttccgctggctcttctgctccacgccgctcggcccgatgtggtcatgac<br>gcagtcaccactgtccctccccgtgacccttggacagccagcgtcgattagctgcaagtcatcccaatccctgctc<br>gattcggatggaaagacctatctcaactggctgcagcaaagacccggtcagagccctaggagactcatctcgttg<br>gtgtcaaagctggacagcggagtgccggaccggttttccggttcgggatcggggacggacttcactctgaagattt<br>cacgggtggaagctgaggatgtgggagtgtactactgctggcagggaacccatttccctggcacttttggcggag<br>gaactaaggtcgaaatcaagggaggaggtggctcgggaggaggcggatcgggcggaggcgggagcggcgg<br>aggagggtccgaaatccaacttgtccagtcaggagccgaagtgaagaaaccgggagccaccgtcaaaatcagc<br>tgtaagggatcgggattcaatatcgaggactactacatccactgggtgcagcaagctccgggcaaaggactggag<br>tggatggggcgcatcgacccagagaacgacgaaaccaaatacggcccgatcttccaagggcgggtgaccatca<br>ccgcggacacctcaactaacactgtgtacatggagctgagctccctgcgctccgaagatactgcagtctactactg<br>cgccttccgcggtggtgtgtactggggacagggcaccactgtgactgtcagctcgaccactaccccagcaccga<br>ggccacccaccccggctcctaccatcgcctcccagcctctgtccctgcgtccggaggcatgtagacccgcagctg<br>gtggggccgtgcatacccggggtcttgacttcgcctgcgatatctacatttgggcccctctggctggtacttgcggg<br>gtcctgctgctttcactcgtgatcactctttactgtaagcgcggtcggaagaagctgctgtacatctttaagcaaccctt<br>catgaggcctgtgcagactactcaagaggaggacggctgttcatgccggttcccagaggaggaggaaggcggc<br>tgcgaactgcgcgtgaaattcagccgcagcgcagatgctccagcctacaagcaggggcagaaccagctctacaa<br>cgaactcaatcttggtcggagagaggagtacgacgtgctggacaagcggagaggacgggacccagaaatggg<br>cgggaagccgcgcagaaagaatccccaagagggcctgtacaacgagctccaaaaggataagatggcagaagc<br>ctatagcgagattggtatgaaaggggaacgcagaagaggcaaaggccacgacggactgtaccagggactcagc<br>accgccaccaaggacacctatgacgctcttcacatgcaggccctgccgcctcgg |
| CAR 8-Full-aa | SEQ ID NO: 752 | malpvtalllplalllhaarpdvvmtqsplslpvtlgqpasisc**kssqslldsdgktyln**wlqqrpgqsprrlis**l**<br>**vsklds**gvpdrfsgsgsgtdftlkisrveaedvgvyyc**wqgthfpgt**fgggtkveikggggsggggsggggs<br>ggggseiqlvqsgaevkkpgatvkisckgsgfnie**dyyih**wvqqapgkglewmg**ridpendetkvgpif**<br>**qg**rvtitadtstntvymelsslrsedtavyycaf**rggvy**wgqgttvtvsstapaprpptpaptiasqplslrpeac<br>rpaaggavhtrgldfacdiyiwaplagtcgvlllslvitlyckrgrkkllyifkqpfmrpvqttqeedgcscrfpee<br>eeggcelrvkfsrsadapaykqgqnqlynelnlgrreeydvldlargrdpemggkprrknpqeglynelqkd<br>kmaeayseigmkgerrrgkghdglyqglstatkdtydalhmqalppr |
| CAR 9 Mouse anti-EGFRvIII clone 3C10 | | |
| CAR9 scFv domain | SEQ ID NO: 754 | eiqlqqsgaelvkpgasvklsctgsgfniedyyihwvkqrteqglewigridpendetkygpifqgratitadts<br>sntvylqlssltsedtavyycafrggvywgpgttltvssggggsggggsggggshmdvvmtqspltlsvaigq<br>sasisckssqslldsdgktylnwllqrpgqspkrlislvskldsgvpdrftgsgsgtdftlrisrveaedlgiyycw<br>qgthfpgtfgggtkleik |
| CAR9 scFv domain nt | SEQ ID NO: 766 | gagatccagctccaacagagcggagccgaactggtcaaaccgggagcgtcggtgaagttgtcatgcactggatc<br>gggcttcaacatcgaggattactacatccactgggtcaagcaacgcaccgagcaggggctggaatggatcggac<br>ggatcgaccccgaaaacgatgaaaccaagtacgggcctatcttccaaggacgggccaccattacggctgacacg<br>tcaagcaataccgtctacctccagctttccagcctgacctccgaggacactgccgtgtactactgcgccttcagagg<br>aggcgtgtactggggaccaggaaccactttgaccgtgtccagcggaggcggtggatcaggaggaggaggctca<br>ggcggtggcggctcgcacatggacgtggtcatgactcagtccccgctgaccctgtcggtggcaattggacagag<br>cgcatccatctcgtgcaagagctcacagtcgctgctggattccgacggaaagacttatctgaactggctgctccaa<br>agaccagggcaatcaccgaaacgccttatctccctggtgtcgaaactcgactcgggtgtgccggatcggtttaccg |

TABLE 9-continued

| Humanized EGFRvIII CAR Constructs | | |
|---|---|---|
| Name | SEQ ID NO: | Sequence |
| | | gtagcgggtccggcacggacttcactctccgcatttcgagggtggaagcggaggatctcgggatctactactgttg gcagggaacccacttccctgggacttttggaggcggaactaagctggaaatcaag |
| CAR9-Soluble scFv-nt | SEQ ID NO: 756 | atggccctccctgtcaccgccctgctgcttccgctggctcttctgctccacgccgctcggcccgagatccagctcca acagagcggagccgaactggtcaaaccgggagcgtcggtgaagttgtcatgcactggatcgggcttcaacatcg aggattactacatccactgggtcaagcaacgcaccgagcaggggctggaatggatcggacggatcgaccccga aaacgatgaaaccaagtacgggcctatcttccaaggacgggccaccattacggctgacacgtcaagcaataccgt ctacctccagctttccagcctgacctccgaggacactgccgtgtactactgcgccttcagaggaggcgtgtactgg ggaccaggaaccactttgaccgtgtccagcggaggcggtggatcaggaggaggaggctcaggcggtggcggc tcgcacatggacgtggtcatgactcagtccccgctgaccctgtcggtggcaattggacagagcgcatccatctcgt gcaagagctcacagtcgctgctggattccgacggaaagacttatctgaactggctgctccaaagaccagggcaat caccgaaacgccttatctccctggtgtcgaaactcgactcgggtgtgccggatcggtttaccggtagcgggtccgg cacggacttcactctccgcatttcgagggtggaagcggaggatctcgggatctactactgttggcagggaaccca cttccctgggacttttggaggcggaactaagctggaaatcaagggtagccatcaccatcaccaccaccatcat |
| CAR9-Soluble scFv-aa | SEQ ID NO: 757 | malpvtalllplalllhaarpeiqlqqsgaelvkpgasvklsctgsgfniedyyihwvkqrteqglewigridpe ndetkygpifqgratitadtssntvylqlssltsedtavyycafrggvywgpgaltvssggggsggggsggggs hmdvvmtqspltlsvaigqsasisckssqslldsdgktylnwllqrpgqspkrlislvskldsgvpdrftgsgsgt dftlrisrveaedlgiyycwqgthfpgtfgggtkleikgshhhhhhhh |
| CAR 9-Full-nt | SEQ ID NO: 758 | atggccctccctgtcaccgccctgctgcttccgctggctcttctgctccacgccgctcggcccgagatccagctcca acagagcggagccgaactggtcaaaccgggagcgtcggtgaagttgtcatgcactggatcgggcttcaacatcg aggattactacatccactgggtcaagcaacgcaccgagcaggggctggaatggatcggacggatcgaccccga aaacgatgaaaccaagtacgggcctatcttccaaggacgggccaccattacggctgacacgtcaagcaataccgt ctacctccagctttccagcctgacctccgaggacactgccgtgtactactgcgccttcagaggaggcgtgtactgg ggaccaggaaccactttgaccgtgtccagcggaggcggtggatcaggaggaggaggctcaggcggtggcggc tcgcacatggacgtggtcatgactcagtccccgctgaccctgtcggtggcaattggacagagcgcatccatctcgt gcaagagctcacagtcgctgctggattccgacggaaagacttatctgaactggctgctccaaagaccagggcaat caccgaaacgccttatctccctggtgtcgaaactcgactcgggtgtgccggatcggtttaccggtagcgggtccgg cacggacttcactctccgcatttcgagggtggaagcggaggatctcgggatctactactgttggcagggaaccca cttccctgggacttttggaggcggaactaagctggaaatcaagaccactaccccagcaccgaggccacccaccc cggctcctaccatcgcctcccagcctctgtccctgcgtccggaggcatgtagacccgcagctggtggggccgtgc atacccggggtcttgacttcgcctgcgatatctacatttgggcccctctggctggtacttgcggggtcctgctgctttc actcgtgatcactctttactgtaagcgcggtcggaagaagctgctgtacatctttaagcaacccttcatgaggcctgt gcagactactcaagaggaggacggctgttcatgccggttcccagaggaggaggaaggcggctgcgaactgcgc gtgaaattcagccgcagcgcagatgctccagcctacaagcaggggcagaaccagctctacaacgaactcaatctt ggtcggagagaggagtacgacgtgctggacaagcggagaggacgggacccagaaatgggcgggaagccgc gcagaaagaatccccaagagggcctgtacaacgagctccaaaaggataagatggcagaagcctatagcgagatt ggtatgaaaggggaacgcagaagaggcaaaggccacgacggactgtaccagggactcagcaccgccaccaa ggacacctatgacgctcttcacatgcaggccctgccgcctcgg |
| CAR 9-Full-aa | SEQ ID NO: 759 | malpvtalllplalllhaarpeiqlqqsgaelvkpgasvklsctgsgfniedyyihwvkqrteqglewigridpe ndetkygpifqgratitadtssntvylqlssltsedtavyycafrggvywgpgttltvssggggsggggsgggg shmdvvmtqspltlsvaigqsasisckssqslldsdgktylnwllqrpgqspkrlislvskldsgvpdrftgsg sgtdftlrisrveaedlgiyycwqgthfpgtfgggtkleikttpaprpptpaptiasqplslrpeacrpaaggavh trgldfacdiyiwaplagtcgvlllslvitlyckrgrkkllyifkqpfmrpvqttqeedgcscrfpeeeeggcelrv kfsrsadapaykqgqnqlynelnlgrreeydvldlargrdpemggkprrknpqeglynelqkdkmaeayse igmkgerrrgkghdglyqglstatkdtydalhmqalppr |

TABLE 9-continued

| Humanized EGFRvIII CAR Constructs | | |
|---|---|---|
| Name | SEQ ID NO: | Sequence |
| CAR10 Anti -EGFRvIII clone 139 | | |
| CAR10 scFv domain | SEQ ID NO: 760 | diqmtqspsslsasvgdrvtitcrasqgirnnlawyqqkpgkapkrliyaasnlqsgvpsrftgsgsgteftlivs<br>slqpedfatyyclqhhsypltsgggtkveikrtgstsgsgkpgsgegsevqvlesggglvqpggslrlscaasgft<br>fssyamswvrqapgkglewvsaisgsggstnyadsvkgrftisrdnskntlylqmnslraedtavyycagssg<br>wseywgqgtlvtvss |
| CAR9 scFv domain nt | SEQ ID NO: 761 | gatatccaaatgactcagagcccttcatccctgagcgccagcgtcggagacagggtgaccatcacgtgccgggc<br>atcccaaggcattagaaataacttggcgtggtatcagcaaaaaccaggaaaggccccgaagcgcctgatctacgc<br>ggcctccaaccttcagtcaggagtgccctcgcgcttcaccgggagcggtagcggaactgagtttacccttatcgtg<br>tcgtccctgcagccagaggacttcgcgacctactactgcctccagcatcactcgtacccgttgacttcgggaggcg<br>gaaccaaggtcgaaatcaaacgcactggctcgacgtcagggtccggtaaaccgggatcgggagaaggatcgga<br>agtccaagtgctggagagcggaggcggactcgtgcaacctggcgggtcgctgcggctcagctgtgccgcgtcg<br>ggttttactttcagctcgtacgctatgtcatgggtgcggcaggctccgggaaaggggctggaatgggtgtccgctat<br>ttccggctcgggtggaagcaccaattacgccgactccgtgaagggacgcttcaccatctcacgggataactccaa<br>gaatactctgtacctccagatgaactcgctgagagccgaggacaccgcagtgtactactgcgcagggtcaagcg<br>gctggtccgaatactggggacagggcaccctcgtcactgtcagctcc |
| CAR10-Soluble scFv nt | SEQ ID NO: - 762 | atggccctccctgtcaccgccctgctgcttccgctggctcttctgctccacgccgctcggcccgatatccaaatgac<br>tcagagcccttcatccctgagcgccagcgtcggagacagggtgaccatcacgtgccgggcatcccaaggcatta<br>gaaataacttggcgtggtatcagcaaaaaccaggaaaggccccgaagcgcctgatctacgcggcctccaaccttc<br>agtcaggagtgccctcgcgcttcaccgggagcggtagcggaactgagtttacccttatcgtgtcgtccctgcagcc<br>agaggacttcgcgacctactactgcctccagcatcactcgtacccgttgacttcgggaggcggaaccaaggtcga<br>aatcaaacgcactggctcgacgtcagggtccggtaaaccgggatcgggagaaggatcggaagtccaagtgctg<br>gagagcggaggcggactcgtgcaacctggcgggtcgctgcggctcagctgtgccgcgtcgggttttactttcagc<br>tcgtacgctatgtcatgggtgcggcaggctccgggaaaggggctggaatgggtgtccgctatttccggctcgggt<br>ggaagcaccaattacgccgactccgtgaagggacgcttcaccatctcacgggataactccaagaatactctgtacc<br>tccagatgaactcgctgagagccgaggacaccgcagtgtactactgcgcagggtcaagcggctggtccgaatac<br>tggggacagggcaccctcgtcactgtcagctcccatcaccatcaccaccaccatcac |
| CAR10-Soluble scFv-aa | SEQ ID NO: 763 | malpvtalllplalllhaarpdiqmtqspsslsasvgdrvtitcrasqgirnnlawyqqkpgkapkrliyaasnlq<br>sgvpsrftgsgsgteftlivsslqpedfatyyclqhhsypltsgggtkveikrtgstsgsgkpgsgegsevqvlesg<br>gglvqpggslrlscaasgftfssyamswvrqapgkglewvsaisgsggstnyadsvkgrftisrdnskntlylq<br>mnslraedtavyycagssgwseywgqgtlvtvsshhhhhhhh |
| CAR 10 Full-nt | SEQ ID NO: 764 | atggccctccctgtcaccgccctgctgcttccgctggctcttctgctccacgccgctcggcccgatatccaaatgac<br>tcagagcccttcatccctgagcgccagcgtcggagacagggtgaccatcacgtgccgggcatcccaaggcatta<br>gaaataacttggcgtggtatcagcaaaaaccaggaaaggccccgaagcgcctgatctacgcggcctccaaccttc<br>agtcaggagtgccctcgcgcttcaccgggagcggtagcggaactgagtttacccttatcgtgtcgtccctgcagcc<br>agaggacttcgcgacctactactgcctccagcatcactcgtacccgttgacttcgggaggcggaaccaaggtcga<br>aatcaaacgcactggctcgacgtcagggtccggtaaaccgggatcgggagaaggatcggaagtccaagtgctg<br>gagagcggaggcggactcgtgcaacctggcgggtcgctgcggctcagctgtgccgcgtcgggttttactttcagc<br>tcgtacgctatgtcatgggtgcggcaggctccgggaaaggggctggaatgggtgtccgctatttccggctcgggt<br>ggaagcaccaattacgccgactccgtgaagggacgcttcaccatctcacgggataactccaagaatactctgtacc<br>tccagatgaactcgctgagagccgaggacaccgcagtgtactactgcgcagggtcaagcggctggtccgaatac<br>tggggacagggcaccctcgtcactgtcagctccaccactaccccagcaccgaggccacccaccccggctcctac<br>catcgcctcccagcctctgtccctgcgtccggaggcatgtagacccgcagctggtggggccgtgcatacccggg<br>gtcttgacttcgcctgcgatatctacatttgggcccctctggctggtacttgcggggtcctgctgctttcactcgtgatc<br>actctttactgtaagcgcggtcggaagaagctgctgtacatctttaagcaacccttcatgaggcctgtgcagactact |

TABLE 9-continued

| Humanized EGFRvIII CAR Constructs | | |
|---|---|---|
| Name | SEQ ID NO: | Sequence |
| | | caagaggaggacggctgttcatgccggttcccagaggaggaggaaggcggctgcgaactgcgcgtgaaattca gccgcagcgcagatgctccagcctacaagcaggggcagaaccagctctacaacgaactcaatcttggtcggaga gaggagtacgacgtgctggacaagcggagaggacgggacccagaaatgggcgggaagccgcgcagaaaga atccccaagagggcctgtacaacgagctccaaaaggataagatggcagaagcctatagcgagattggtatgaaa ggggaacgcagaagaggcaaaggccacgacggactgtaccagggactcagcaccgccaccaaggacaccta tgacgctcttcacatgcaggccctgccgcctcgg |
| CAR 10 Full-aa | SEQ ID NO: 765 | malpvtalllplalllhaarpdiqmtqspsslsasvgdrvtitcrasqgirnnlawyqqkpgkapkrliyaasnlq sgvpsrftgsgsgteftlivsslqpedfatyyclqhhsypltsgggtkveikrtgstsgsgkpgsgegsevqvlesg gglvqpggslrlscaasgftfssyamswvrqapgkglewvsaisgsggstnyadsvkgrftisrdnskntlylq mnslraedtavyycagssgwseywgqgtlvtvsstapaprpptpaptiasqplslrpeacrpaaggavhtrgld facdiyiwaplagtcgvlllslvitlyckrgrkkllyifkqpfmrpvqttqeedgcscrfpeeeeggcelrvkfsrs adapaykqgqnqlynelnlgneeydvldlargrdpemggkpnknpqeglynelqkdkmaeayseigmk gerrrgkghdglyqglstatkdtydalhmqalppr |

Mesothelin CAR and Mesothelin-Binding Sequences

In some embodiments, the CAR-expressing cell described herein is a mesothelin CAR-expressing cell (e.g., a cell expressing a CAR that binds to human mesothelin). Exemplary mesothelin CARs can include sequences disclosed in WO2015090230 and WO2017112741, e.g., Tables 2, 3, 4, and 5 of WO2017112741, incorporated herein by reference.

Exemplary mesothelin-binding sequences or mesothelin CAR sequences may comprise a CDR, a variable region, an scFv, or a full-length CAR sequence of a sequence disclosed in Table 10 (or a sequence at least about 85%, 90%, 95%, 99% or more identical thereto, and/or having one, two, three or more substitutions, insertions, deletions, or modifications).

TABLE 10

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 653 | M1 (ScFv domain) | QVQLQQSGAEVKKPGASVKVSCKASGYTFTGYYMHWVRQ<br>APGQGLEWMGRINPNSGGTNYAQKFQGRVTMTRDTSISTAYMELSRLRSEDTAVYYCARG<br>RYYGMDVWGQGTMVTVSSGGGGSGGGGSGGGGSGGGGSEIVLTQSPATLSLSPGERATIS<br>CRASQSVSSNFAWYQQRPGQAPRLLIYDASNRATGIPPRFSGSGSGTDFTLTISSLEPED<br>FAAYYCHQRSNWLYTFGQGTKVDIK |
| SEQ ID NO: 709 | M1 (full) >ZA53-27BC (M1 ZA53-27BC R001-A11 126161) | **MALPVTALLLPLALLLHAARP**QVQLQQSGAEVKKPGASVKVSCKASGYTFTGYYMHWVRQ<br>APGQGLEWMGRINPNSGGTNYAQKFQGRVTMTRDTSISTAYMELSRLRSEDTAVYYCARG<br>RYYGMDVWGQGTMVTVSSGGGGSGGGGSGGGGSGGGGSEIVLTQSPATLSLSPGERATIS<br>CRASQSVSSNFAWYQQRPGQAPRLLIYDASNRATGIPPRFSGSGSGTDFTLTISSLEPED<br>FAAYYCHQRSNWLYTFGQGTKVDIKTTTPAPRPPTPAPTIASQPLSLRPEACRPAAGGAV<br>HTRGLDFACDIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVLDKRRGRDPE<br>MGGKPRRKNPQEGLYNELQKDKMAEAYSEIGMKGERRRGKGHDGLYQGLSTATKDTYDAL<br>HMQALPPR |
| SEQ ID NO: 655 | M2 (ScFv domain) | QVQLVQSGAEVKKPGASVKVSCKASGYTFTGYYMHWVRQ<br>APGQGLEWMGWINPNSGGTNYAQKFQGRVTMTRDTSISTAYMELSRLRSDDTAVYYCARD<br>LRRTVVTPRAYYGMDVWGQGTTVTVSSGGGGSGGGGSGGGGSGGGGSDIQLTQSPSTLSA<br>SVGDRVTITCQASQDISNSLNWYQQKAGKAPKLLIYDASTLETGVPSRFSGSGSGTDFSF<br>TISSLQPEDIATYYCQQHDNLPLTFGQGTKVEIK |
| SEQ ID NO: 711 | M2 (full) >FA56-26RC (M2 FA56-26RC R001-A10 126162) | **MALPVTALLLPLALLLHAARP**QVQLVQSGAEVKKPGASVKVSCKASGYTFTGYYMHWVRQ<br>APGQGLEWMGWINPNSGGTNYAQKFQGRVTMTRDTSISTAYMELSRLRSDDTAVYYCARD<br>LRRTVVTPRAYYGMDVWGQGTTVTVSSGGGGSGGGGSGGGGSGGGGSDIQLTQSPSTLSA<br>SVGDRVTITCQASQDISNSLNWYQQKAGKAPKLLIYDASTLETGVPSRFSGSGSGTDFSF<br>TISSLQPEDIATYYCQQHDNLPLTFGQGTKVEIKTTTPAPRPPTPAPTIASQPLSLRPEA<br>CRPAAGGAVHTRGLDFACDIYIWAPLAGTCGVLLLSLVITLYCKRGRKKLLYIFKQPFMR<br>PVQTTQEEDGCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGHDGLYQGLST<br>ATKDTYDALHMQALPPR |
| SEQ ID NO: 657 | M3 (ScFv domain) | QVQLVQSGAEVKKPGAPVKVSCKASGYTFTGYYMHWVRQ<br>APGQGLEWMGWINPNSGGTNYAQKFQGRVTMTRDTSISTAYMELSRLRSDDTAVYYCARG<br>EWDGSYYYDYWGQGTLVTVSSGGGGSGGGGSGGGGSGGGGSDIVLTQTPSSLSASVGDRV<br>TITCRASQSINTYLNWYQHKPGKAPKLLIYAASSLQSGVPSRFSGSGSGTDFTLTISSLQ<br>PEDFATYYCQQSFSPLTFGGGTKLEIK |
| SEQ ID NO: 713 | M3 >VA58-21LC (M3 VA58-21LC R001-A1 126163) | **MALPVTALLLPLALLLHAARP**QVQLVQSGAEVKKPGAPVKVSCKASGYTFTGYYMHWVRQ<br>APGQGLEWMGWINPNSGGTNYAQKFQGRVTMTRDTSISTAYMELSRLRSDDTAVYYCARG<br>EWDGSYYYDYWGQGTLVTVSSGGGGSGGGGSGGGGSGGGGSDIVLTQTPSSLSASVGDRV<br>TITCRASQSINTYLNWYQHKPGKAPKLLIYAASSLQSGVPSRFSGSGSGTDFTLTISSLQ<br>PEDFATYYCQQSFSPLTFGGGTKLEIKTTTPAPRPPTPAPTIASQPLSLRPEACRPAAGG<br>AVHTRGLDFACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYDVLDKRRGRD<br>PEMGGKPRRKNPQEGLYNELQKDKMAEAYSEIGMKGERRRGKGHDGLYQGLSTATKDTYD<br>ALHMQALPPR |
| SEQ ID NO: 659 | M4 (ScFv domain) | QVQLVESGGGLVQPGGSLRLSCAASGFTFSSYWMHWVRQ<br>VPGKGLVWVSRINTDGSTTTYADSVEGRFTISRDNAKNTLYLQMNSLRDDDTAVYYCVGG<br>HWAVWGQGTTVTVSSGGGGSGGGGSGGGGSGGGGSDIQMTQSPSTLSASVGDRVTITCRA<br>SQSISDRLAWYQQKPGKAPKLLIYKASSLESGVPSRFSGSGSGTEFTLTISSLQPDDFAV<br>YYCQQYGHLPMYTFGQGTKVEIK |
| SEQ ID NO: 715 | M4 >DP37-07IC (M4 DP37-07IC | **MALPVTALLLPLALLLHAARP**QVQLVESGGGLVQPGGSLRLSCAASGFTFSSYWMHWVRQ<br>VPGKGLVWVSRINTDGSTTTYADSVEGRFTISRDNAKNTLYLQMNSLRDDDTAVYYCVGG<br>HWAVWGQGTTVTVSSGGGGSGGGGSGGGGSGGGGSDIQMTQSPSTLSASVGDRVTITCRA<br>SQSISDRLAWYQQKPGKAPKLLIYKASSLESGVPSRFSGSGSGTEFTLTISSLQPDDFAV<br>YYCQQYGHLPMYTFGQGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC |

TABLE 10-continued

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| | R001-C6 126164) | SCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 661 | M5 (ScFv domain) | QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK |
| SEQ ID NO: 717 | M5 >XP31-20LC (M5 XP31-20LC R001-B4 126165) | **MALPVTALLLPLALLLHAARP**QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 663 | M6 (ScFv domain) | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK |
| SEQ ID NO: 719 | M6 >FE10-06ID (M6 46FE10-06ID R001-A4 126166) | **MALPVTALLLPLALLLHAARP**QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 665 | M7 (ScFv domain) | QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK |
| SEQ ID NO: 721 | M7 >VE12-01CD (M7 VE12-01CD R001-A5 126167) | **MALPVTALLLPLALLLHAARP**QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 667 | M8 (ScFv domain) | QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK |
| SEQ ID NO: 723 | M8 >LE13-05XD (M8 LE13-05XD R001-E5 126168) | **MALPVTALLLPLALLLHAARP**QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

TABLE 10-continued

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 810 | M9 (ScFv domain) | QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK |
| SEQ ID NO: 725 | M9 >BE15-00SD (M9 BE15-00SD R001-A3 126169) | **MALPVTALLLPLALLLHAARP**QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 670 | M10 (ScFv domain) | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN |
| SEQ ID NO: 727 | M10 >RE16-05MD (M10 RE16-05MD R001-D1 0126170) | **MALPVTALLLPLALLLHAARP**QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 672 | M11 (ScFv domain) | QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK |
| SEQ ID NO: 729 | M11 >NE10-19WD (M11 NE10-19WD R001-G2 126171) | **MALPVTALLLPLALLLHAARP**QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 675 | M12 (ScFv domain) | QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK |
| SEQ ID NO: 731 | M12 >DE12-14RD (M12 DE12-14RD R001-G9 126172) | **MALPVTALLLPLALLLHAARP**QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 678 | M13 (ScFv domain) | QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK |

TABLE 10-continued

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 733 | M13 >TE13-19LD (M13 TE13-19LD R002-C3 126173) | **MALPVTALLLPLALLLHAARP**QVQLVQSGGGLVKPGGSLRLSCEASGFIFSDYYMGWIRQ<br>APGKGLEWVSYIGRSGSSMYYADSVKGRFTFSRDNAKNSLYLQMNSLRAEDTAVYYCAAS<br>PVVAATEDFQHWGQGTLVTVSSGGGGSGGGGSGGGGSGGGGSDIVMTQTPATLSLSPGER<br>ATLSCRASQSVTSNYLAWYQQKPGQAPRLLLFGASTRATGIPDRFSGSGSGTDFTLTINR<br>LEPEDFAMYYCQQYGSAPVTFGQGTKLEIKTTTPAPRPPTPAPTIASQPLSLRPEACRPA<br>AGGAVHTRGLDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRREEYDVLDKRR<br>GRDPEMGGKPRRKNPQEGLYNELQKDKMAEAYSEIGMKGERRRGKGHDGLYQGLSTATKD<br>TYDALHMQALPPR |
| SEQ ID NO: 681 | M14 (ScFv domain) | QVQLVQSGAEVRAPGASVKISCKASGFTFRGYYIHWVRQ<br>APGQGLEWMGIINPSGGSRAYAQKFQGRVTMTRDTSTSTVYMELSSLRSDDTAMYYCART<br>ASCGGDCYYLDYWGQGTLVTVSSGGGGSGGGGSGGGGSGGGGSDIQMTQSPPTLSASVGD<br>RVTITCRASENVNIWLAWYQQKPGKAPKLLIYKSSSLASGVPSRFSGSGSGAEFTLTISS<br>LQPDDFATYYCQQYQSYPLTFGGGTKVDIK |
| SEQ ID NO: 735 | M14 >BS83-95ID (M14 BS83-95ID R001-E8 126174) | **MALPVTALLLPLALLLHAARP**QVQLVQSGAEVRAPGASVKISCKASGFTFRGYYIHWVRQ<br>APGQGLEWMGIINPSGGSRAYAQKFQGRVTMTRDTSTSTVYMELSSLRSDDTAMYYCART<br>ASCGGDCYYLDYWGQGTLVTVSSGGGGSGGGGSGGGGSGGGGSDIQMTQSPPTLSASVGD<br>RVTITCRASENVNIWLAWYQQKPGKAPKLLIYKSSSLASGVPSRFSGSGSGAEFTLTISS<br>LQPDDFATYYCQQYQSYPLTFGGGTKVDIKTTTPAPRPPTPAPTIASQPLSLRPEACRPA<br>AGGAVHTRGLDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRREEYDVLDKRR<br>GRDPEMGGKPRRKNPQEGLYNELQKDKMAEAYSEIGMKGERRRGKGHDGLYQGLSTATKD<br>TYDALHMQALPPR |
| SEQ ID NO: 684 | M15 (ScFv domain) | QVQLVQSGGGLVQPGRSLRLSCAASGFTFDDYAMHWVRQ<br>APGKGLEWVSGISWNSGSIGYADSVKGRFTISRDNAKNSLYLQMNSLRAEDTAVYYCAKD<br>GSSSWSWGYFDYWGQGTLVTVSSGGGGSGGGGSGGGGSSSELTQDPAVSVALGQTVRTTC<br>QGDALRSYYASWYQQKPGQAPMLVIYGKNNRPSGIPDRFSGSDSGDTASLTITGAQAEDE<br>ADYYCNSRDSSGYPVFGTGTKVTVL |
| SEQ ID NO: 737 | M15 >HS86-94XD (M15 H586-94XD NT 127553) | **MALPVTALLLPLALLLHAARP**QVQLVQSGGGLVQPGRSLRLSCAASGFTFDDYAMHWVRQ<br>APGKGLEWVSGISWNSGSIGYADSVKGRFTISRDNAKNSLYLQMNSLRAEDTAVYYCAKD<br>GSSSWSWGYFDYWGQGTLVTVSSGGGGSGGGGSGGGGSSSELTQDPAVSVALGQTVRTTC<br>QGDALRSYYASWYQQKPGQAPMLVIYGKNNRPSGIPDRFSGSDSGDTASLTITGAQAEDE<br>ADYYCNSRDSSGYPVFGTGTKVTVLTTTPAPRPPTPAPTIASQPLSLRPEACRPAAGGAV<br>HTRGLDFACDIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVLDKRRGRDPE<br>MGGKPRRKNPQEGLYNELQKDKMAEAYSEIGMKGERRRGKGHDGLYQGLSTATKDTYDAL<br>HMQALPPR |
| SEQ ID NO: 687 | M16 (ScFv domain) | EVQLVESGGGLVQPGRSLRLSCAASGFTFDDYAMHWVRQ<br>APGKGLEWVSGISWNSGSTGYADSVKGRFTISRDNAKNSLYLQMNSLRAEDTALYYCAKD<br>SSSWYGGGSAFDIWGQGTMVTVSSGGGGSGGGGSGGGGSSSELTQEPAVSVALGQTVRIT<br>CQGDSLRSYYASWYQQKPGQAPVLVIFGRSRRPSGIPDRFSGSSSGNTASLIITGAQAED<br>EADYYCNSRDNTANHYVFGTGTKLTVL |
| SEQ ID NO: 739 | M16 >XS87-99RD (M16 XS87-99RD NT 127554) | **MALPVTALLLPLALLLHAARP**EVQLVESGGGLVQPGRSLRLSCAASGFTFDDYAMHWVRQ<br>APGKGLEWVSGISWNSGSTGYADSVKGRFTISRDNAKNSLYLQMNSLRAEDTALYYCAKD<br>SSSWYGGGSAFDIWGQGTMVTVSSGGGGSGGGGSGGGGSSSELTQEPAVSVALGQTVRIT<br>CQGDSLRSYYASWYQQKPGQAPVLVIFGRSRRPSGIPDRFSGSSSGNTASLIITGAQAED<br>EADYYCNSRDNTANHYVFGTGTKLTVLTTTPAPRPPTPAPTIASQPLSLRPEACRPAAGG<br>AVHTRGLDFACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYDVLDKRRGRD<br>PEMGGKPRRKNPQEGLYNELQKDKMAEAYSEIGMKGERRRGKGHDGLYQGLSTATKDTYD<br>ALHMQALPPR |
| SEQ ID NO: 690 | M17 (ScFv domain) | EVQLVESGGGLVQPGRSLRLSCAASGFTFDDYAMHWVRQ<br>APGKGLEWVSGISWNSGSTGYADSVKGRFTISRDNAKNSLYLQMNSLRAEDTALYYCAKD<br>SSSWYGGGSAFDIWGQGTMVTVSSGGGGSGGGGSGGGGSSSELTQDPAVSVALGQTVRIT<br>CQGDSLRSYYASWYQQKPGQAPVLVIYGKNNRPSGIPDRFSGSSSGNTASLTITGAQAED<br>EADYYCNSRGSSGNHYVFGTGTKVTVL |
| SEQ ID NO: 741 | M17 >NS 89-94MD (M17 NS89- | **MALPVTALLLPLALLLHAARP**EVQLVESGGGLVQPGRSLRLSCAASGFTFDDYAMHWVRQ<br>APGKGLEWVSGISWNSGSTGYADSVKGRFTISRDNAKNSLYLQMNSLRAEDTALYYCAKD<br>SSSWYGGGSAFDIWGQGTMVTVSSGGGGSGGGGSGGGGSSSELTQDPAVSVALGQTVRIT<br>CQGDSLRSYYASWYQQKPGQAPVLVIYGKNNRPSGIPDRFSGSSSGNTASLTITGAQAED<br>EADYYCNSRGSSGNHYVFGTGTKVTVLTTTPAPRPPTPAPTIASQPLSLRPEACRPAAGG |

TABLE 10-continued

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| | 94MD NT 127555) | AVHTRGLDFACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKGHDGLYQGLSTATKDTYD ALHMQALPPR |
| SEQ ID NO: 693 | M18 (ScFv domain) | QVQLVQSGGGLVQPGGSLRLSCAASGFTFSSYWMHWVRQ APGKGLVWVSRINSDGSSTSYADSVKGRFTISRDNAKNTLYLQMNSLRAEDTAVYYCVRT GWVGSYYYYMDVWGKGTTVTVSSGGGGSGGGGSGGGGSGGGGSEIVLTQSPGTLSLSPGE RATLSCRASQSVSSNYLAWYQQKPGQPPRLLIYDVSTRATGIPARFSGGGSGTDFTLTIS SLEPEDFAVYYCQQRSNWPPWTFGQGTKVEIK |
| SEQ ID NO: 743 | M18 >D590-09HD (M18 D590-09HD R003-A05 127556) | **MALPVTALLLPLALLLHAARP**QVQLVQSGGGLVQPGGSLRLSCAASGFTFSSYWMHWVRQ APGKGLVWVSRINSDGSSTSYADSVKGRFTISRDNAKNTLYLQMNSLRAEDTAVYYCVRT GWVGSYYYYMDVWGKGTTVTVSSGGGGSGGGGSGGGGSGGGGSEIVLTQSPGTLSLSPGE RATLSCRASQSVSSNYLAWYQQKPGQPPRLLIYDVSTRATGIPARFSGGGSGTDFTLTIS SLEPEDFAVYYCQQRSNWPPWTFGQGTKVEIKTTTPAPRPPTPAPTIASQPLSLRPEACR PAAGGAVHTRGLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDGLYQGLSTAT KDTYDALHMQALPPR |
| SEQ ID NO: 696 | M19 (ScFv domain) | QVQLVQSGGGVVQPGRSLRLSCAASGFTFSSYGMHWVRQ APGKGLEWVAVISYDGSNKYYADSVKGRFTISRDNSKNTLYLQMNSLRAEDTAVYYCAKG YSRYYYYGMDVWGQGTTVTVSSGGGGSGGGGSGGGGSGGGGSEIVMTQSPATLSLSPGER AILSCRASQSVYTKYLGWYQQKPGQAPRLLIYDASTRATGIPDRFSGSGSGTDFTLTINR LEPEDFAVYYCQHYGGSPLITFGQGTKVDIK |
| SEQ ID NO: 745 | M19 >T592-04BD (M19 T592-04BD R003-C06 127557) | **MALPVTALLLPLALLLHAARP**QVQLVQSGGGVVQPGRSLRLSCAASGFTFSSYGMHWVRQ APGKGLEWVAVISYDGSNKYYADSVKGRFTISRDNSKNTLYLQMNSLRAEDTAVYYCAKG YSRYYYYGMDVWGQGTTVTVSSGGGGSGGGGSGGGGSGGGGSEIVMTQSPATLSLSPGER AILSCRASQSVYTKYLGWYQQKPGQAPRLLIYDASTRATGIPDRFSGSGSGTDFTLTINR LEPEDFAVYYCQHYGGSPLITFGQGTKVDIKTTTPAPRPPTPAPTIASQPLSLRPEACRP AAGGAVHTRGLDFACDIYIWAPLAGTCGVLLLSLVITLYCKRGRKKLLYIFKQPFMRPVQ TTQEEDGCSCRFPEEEEGGCELRVKFSRSADAPAYKQGQNQLYNELNLGRREEYDVLDKR RGRDPEMGGKPRRKNPQEGLYNELQKDKMAEAYSEIGMKGERRRGKGHDGLYQGLSTATK DTYDALHMQALPPR |
| SEQ ID NO: 699 | M20 (ScFv domain) | QVQLVQSGGGLVQPGGSLRLSCAASGFTFSSYAMSWVRQ APGKGLEWVSAISGSGGSTYYADSVKGRFTISRDNSKNTLYLQMNSLRAEDTAVYYCAKR EAAAGHDWYFDLWGRGTLVTVSSGGGGSGGGGSGGGGSGGGGSDIRVTQSPSSLSASVGD RVTITCRASQSISSYLNWYQQKPGKAPKLLIYAASSLQSGVPSRFSGSGSGTDFTLTISS LQPEDFATYYCQQSYSIPLTFGQGTKVEIK |
| SEQ ID NO: 747 | M20 (full) >JS93-08WD (M20 JS93-08WD R003-E07 127558) | **MALPVTALLLPLALLLHAARP**QVQLVQSGGGLVQPGGSLRLSCAASGFTFSSYAMSWVRQ APGKGLEWVSAISGSGGSTYYADSVKGRFTISRDNSKNTLYLQMNSLRAEDTAVYYCAKR EAAAGHDWYFDLWGRGTLVTVSSGGGGSGGGGSGGGGSGGGGSDIRVTQSPSSLSASVGD RVTITCRASQSISSYLNWYQQKPGKAPKLLIYAASSLQSGVPSRFSGSGSGTDFTLTISS LQPEDFATYYCQQSYSIPLTFGQGTKVEIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 701 | M21 (ScFv domain) | QVQLVQSWAEVKKPGASVKVSCKASGYTFTSYYMHWVRQAPGQGLEWMGIINPSGGSTSY AQKFQGRVTMTRDTSTSTVYMELSNLRSEDTAVYYCARSPRVTTGYFDYWGQGTLVTVSS GGGGSGGGGSGGGGSGGGGSDIQLTQSPSTLSASVGDRVTITCRASQSISSWLAWYQQKP GKAPKLLIYKASSLESGVPSRFSGSGSGTEFTLTISSLQPDDFATYYCQQYSSYPLTFGG GTRLEIK |
| SEQ ID NO: 749 | M21 (full CAR) | **MALPVTALLLPLALLLHAARP**QVQLVQSWAEVKKPGASVKVSCKASGYTFTSYYMHWVRQ APGQGLEWMGIINPSGGSTSYAQKFQGRVTMTRDTSTSTVYMELSNLRSEDTAVYYCARS PRVTTGYFDYWGQGTLVTVSSGGGGSGGGGSGGGGSGGGGSDIQLTQSPSTLSASVGDRV TITCRASQSISSWLAWYQQKPGKAPKLLIYKASSLESGVPSRFSGSGSGTEFTLTISSLQ PDDFATYYCQQYSSYPLTFGGGTRLEIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |

TABLE 10-continued

Amino Acid Sequences of Human scFvs and CARs that bind to mesothelin (bold underline is the leader sequence and grey box is a linker sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 703 | M22 (ScFv domain) | QVQLVQSGAEVRRPGASVKISCRASGDTSTRHYIHWLRQAPGQGPEWMGVINPTTGPATG<br>SPAYAQMLQGRVTMTRDTSTRTVYMELRSLRFEDTAVYYCARSVVGRSAPYYFDYWGQGT<br>LVTVSSGGGGSGGGGSGGGGSGGGGSDIQMTQSPSSLSASVGDRVTITCRASQGISDYSA<br>WYQQKPGKAPKLLIYAASTLQSGVPSRFSGSGSGTDFTLTISYLQSEDFATYYCQQYYSY<br>PLTFGGGTKVDIK |
| SEQ ID NO: 751 | M22 (full CAR) | **MALPVTALLLPLALLLHAARP**QVQLVQSGAEVRRPGASVKISCRASGDTSTRHYIHWLRQ<br>APGQGPEWMGVINPTTGPATGSPAYAQMLQGRVTMTRDTSTRTVYMELRSLRFEDTAVYY<br>CARSVVGRSAPYYFDYWGQGTLVTVSSGGGGSGGGGSGGGGSGGGGSDIQMTQSPSSLSA<br>SVGDRVTITCRASQGISDYSAWYQQKPGKAPKLLIYAASTLQSGVPSRFSGSGSGTDFTL<br>TISYLQSEDFATYYCQQYYSYPLTEGGGTKVDIKTTTPAPRPPTPAPTIASQPLSLRPEA<br>CRPA<br>AGGAVHTRGLDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRREEYDVLDKRR<br>GRDPEMGGKPRRKNPQEGLYNELQKDKMAEAYSEIGMKGERRRGKGHDGLYQGLSTATKD<br>TYDALHMQALPPR |
| SEQ ID NO: 705 | M23 (ScFv domain) | QVQLQQSGAEVKKPGASVKVSCKASGYTFTNYYMHWVRQAPGQGLEWMGIINPSGGYTTY<br>AQKFQGRLTMTRDTSTSTVYMELSSLRSEDTAVYYCARIRSCGGDCYYFDNWGQGTLVTV<br>SSGGGGSGGGGSGGGGSGGGGSDIQLTQSPSTLSASVGDRVTITCRASENVNIWLAWYQQ<br>KPGKAPKLLIYKSSSLASGVPSRFSGSGSGAEFTLTISSLQPDDFATYYCQQYQSYPLTF<br>GGGTKVDIK |
| SEQ ID NO: 753 | M23 (full CAR) | **MALPVTALLLPLALLLHAARP**QVQLQQSGAEVKKPGASVKVSCKASGYTFTNYYMHWVRQ<br>APGQGLEWMGIINPSGGYTTYAQKFQGRLTMTRDTSTSTVYMELSSLRSEDTAVYYCARI<br>RSCGGDCYYFDNWGQGTLVTVSSGGGGSGGGGSGGGGSGGGGSDIQLTQSPSTLSASVGD<br>RVTITCRASENVNIWLAWYQQKPGKAPKLLIYKSSSLASGVPSRFSGSGSGAEFTLTISS<br>LQPDDFATYYCQQYQSYPLTEGGGTKVDIKTTTPAPRPPTPAPTIASQPLSLRPEACRPA<br>AGGAVHTRGLDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRREEYDVLDKRR<br>GRDPEMGGKPRRKNPQEGLYNELQKDKMAEAYSEIGMKGERRRGKGHDGLYQGLSTATKD<br>TYDALHMQALPPR |
| SEQ ID NO: 707 | M24 (ScFv domain) | QITLKESGPALVKPTQTLTLTCTFSGFSLSTAGVHVGWIRQPPGKALEWLALISWADDKR<br>YRPSLRSRLDITRVTSKDQVVLSMTNMQPEDTATYYCALQGFDGYEANWGPGTLVTVSSG<br>GGGSGGGGSGGGGSGGGGSDIVMTQSPSSLSASAGDRVTITCRASRGISSALAWYQQKPG<br>KPPKLLIYDASSLESGVPSRFSGSGSGTDFTLTIDSLEPEDFATYYCQQSYSTPWTFGQG<br>TKVDIK |
| SEQ ID NO: 755 | M24 (full CAR) | **MALPVTALLLPLALLLHAARP**QITLKESGPALVKPTQTLTLTCTFSGFSLSTAGVHVGWI<br>RQPPGKALEWLALISWADDKRYRPSLRSRLDITRVTSKDQVVLSMTNMQPEDTATYYCAL<br>QGFDGYEANWGPGTLVTVSSGGGGSGGGGSGGGGSGGGGSDIVMTQSPSSLSASAGDRVT<br>ITCRASRGISSALAWYQQKPGKPPKLLIYDASSLESGVPSRFSGSGSGTDFTLTIDSLEP<br>EDFATYYCQQSYSTPWTFGQGTKVDIKTTTPAPRPPTPAPTIASQPLSLRPEACRPA<br>AGGAVHTRGLDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRREEYDVLDKRR<br>GRDPEMGGKPRRKNPQEGLYNELQKDKMAEAYSEIGMKGERRRGKGHDGLYQGLSTATKD<br>TYDALHMQALPPR |
| SEQ ID NO: 275 | Ss1 (scFv domain) | QVQLQQSGPELEKPGASVKISCKASGYSFTGYTMNWVKQSHGKSLEWIGLITPYNGASS<br>YNQKFRGKATLTVDKSSSTAYMDLLSLTSEDSAVYFCARGGYDGRGFDYWGQGTTVTVS<br>SGGGGSGGGGSGGGGSDIELTQSPAIMSASPGEKVTMTCSASSSVSYMHWYQQKSGTSP<br>KRWIYDTSKLASGVPGRFSGSGSGNSYSLTISSVEAEDDATYYCQQWSGYPLTFGAGTK<br>LEI |
| SEQ ID NO: 278 | Ss1 (full CAR) | **MALPVTALLLPLALLLHAARP**QVQLQQSGPELEKPGASVKISCKASGYSFTGYTMNWVK<br>QSHGKSLEWIGLITPYNGASSYNQKFRGKATLTVDKSSSTAYMDLLSLTSEDSAVYFCA<br>RGGYDGRGFDYWGQGTTVTVSSGGGGSGGGGSGGGGSDIELTQSPAIMSASPGEKVTMT<br>CSASSSVSYMHWYQQKSGTSPKRWIYDTSKLASGVPGRFSGSGSGNSYSLTISSVEAED<br>DATYYCQQWSGYPLTFGAGTKLEITTTPAPRPPTPAPTIASQPLSLRPEACRPAAGGAV<br>HTRGLDFACDIYIWAPLAGTCGVLLLSLVITLYCKRGRKKLLYIFKQPFMRPVQTTQEE<br>DGCSCRFPEEEEGGCELRVKFSRSADAPA |

RNA Transfection

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 841). RNA so produced can efficiently transfect different kinds of cells. In one aspect, the template includes sequences for the CAR.

In one aspect the CAR is encoded by a messenger RNA (mRNA). In one aspect the mRNA encoding the CAR is introduced into an immune effector cell, e.g., a T cell or a NK cell, for production of a CAR-expressing cell (e.g., CART cell or CAR-expressing NK cell).

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR of the present invention. For example, the template for the RNA CAR comprises an extracellular region comprising a single chain variable domain of an anti-tumor antibody; a hinge region, a transmembrane domain (e.g., a transmembrane domain of CD8a); and a cytoplasmic region that includes an intracellular signaling domain, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100 T tail (SEQ ID NO: 842) (size can be 50-5000 T (SEQ ID NO: 843)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 844).

Poly(A) tails of RNAs can be further extended following in vitro transcription with the use of a poly(A) polymerase, such as *E. coli* polyA polymerase (E-PAP). In one embodiment, increasing the length of a poly(A) tail from 100 nucleotides to between 300 and 400 nucleotides (SEQ ID NO: 845) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA. 5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mob. Ther. 16(2008):580-589; Grabundzija et al. Mob. Ther. 18(2010):1200-1209; Kebriaei et ab. Blood. 122.21(2013): 166; Williams Molecular Therapy 16.9(2008):1515-16; Bell et ab. Nat. Protoc. 2.12(2007):3153-65; and Ding et ab. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

Accordingly, in one aspect, the invention pertains to an isolated nucleic acid molecule encoding a chimeric antigen receptor (CAR), wherein the CAR comprises an antigen binding domain, a transmembrane domain, and an intracellular signaling domain comprising a stimulatory domain, e.g., a costimulatory signaling domain and/or a primary signaling domain, e.g., zeta chain.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, CRISPR, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

An example of a promoter that is capable of expressing a CAR transgene in a mammalian T cell is the EF1a promoter. The native EF 1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009).

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

```
WT PGK Promoter
                                         (SEQ ID NO: 673)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT
```

-continued

```
TACACGCTCTGGGTCCCAGCCGCGGCGACGCAAAGGGCCTTGGTGCGGGT

CTCGTCGGCGCAGGGACGCGTTTGGGTCCCGACGGAACCTTTTCCGCGTT

GGGGTTGGGGCACCATAAGCT

Exemplary truncated PGK Promoters:
PGK100:
                                         (SEQ ID NO: 676)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG

PGK200:
                                         (SEQ ID NO: 679)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG

PGK300:
                                         (SEQ ID NO: 682)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG

PGK400:
                                         (SEQ ID NO: 685)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCG
```

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In one embodiment, the vector can further comprise a nucleic acid encoding a second CAR. In one embodiment, the second CAR includes an antigen binding domain to a target expressed on acute myeloid leukemia cells, such as, e.g., CD123, CD34, CLL-1, folate receptor beta, or FLT3; or a target expressed on a B cell, e.g., CD10, CD19, CD20, CD22, CD34, CD123, FLT-3, ROR1, CD79b, CD179b, or CD79a. In one embodiment, the vector comprises a nucleic acid sequence encoding a first CAR that specifically binds a first antigen and includes an intracellular signaling domain having a costimulatory signaling domain but not a primary signaling domain, and a nucleic acid encoding a second CAR that specifically binds a second, different, antigen and includes an intracellular signaling domain having a primary signaling domain but not a costimulatory signaling domain.

In one embodiment, the vector comprises a nucleic acid encoding a CAR described herein and a nucleic acid encoding an inhibitory CAR. In one embodiment, the inhibitory CAR comprises an antigen binding domain that binds an antigen found on normal cells but not cancer cells. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR beta.

In embodiments, the vector may comprise two or more nucleic acid sequences encoding a CAR, e.g., a CAR described herein and a second CAR, e.g., an inhibitory CAR or a CAR that specifically binds to a different antigen. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include the following, wherein the GSG residues are optional:

```
T2A:
                                   (SEQ ID NO: 688)
(GSG)EGRGSLLTCGDVEENPGP

P2A:
                                   (SEQ ID NO: 691)
(GSG)ATNFSLLKQAGDVEENPGP

E2A:
                                   (SEQ ID NO: 694)
(GSG)QCTNYALLKLAGDVESNPGP

F2A:
                                   (SEQ ID NO: 697)
(GSG)VKQTLNFDLLKLAGDVESNPGP
```

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Choi") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian T cells or NK cells. In one aspect, the mammalian T cell is a human T cell. In one aspect, the mammalian NK cell is a human NK cell. In one embodiment, the vector is selected from the group consisting of a DNA vector, an RNA vector, a plasmid vector, a lentivirus vector, an adenoviral vector, or a retrovirus vector.

Further disclosed is a vector comprising a nucleic acid molecule encoding an RNA molecule disclosed herein, e.g., an immune stimulatory RNA molecule disclosed herein. In one embodiment, the vector can be directly transduced into a cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the RNA molecule in mammalian T cells or NK cells. In one aspect, the mammalian T cell is a human T cell. In one aspect, the mammalian NK cell is a human NK cell. In one embodiment, the vector is selected from the group consisting of a DNA vector, an RNA vector, a plasmid vector, a lentivirus vector, an adenoviral vector, or a retrovirus vector. In some embodiments, the nucleic acid molecule encoding the CAR and the nucleic acid molecule encoding the RNA molecule, e.g., the immune stimulatory RNA molecule, are disposed on a single vector. In some embodiments, the nucleic acid molecule encoding the CAR and the nucleic acid molecule encoding the RNA molecule, e.g., the immune stimulatory RNA molecule, are disposed on separate vectors.

Sources of Cells

Prior to expansion and genetic modification, a source of cells, e.g., immune effector cells (e.g., T cells or NK cells), is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain aspects of the present invention, any number of immune effector cell (e.g., T cell or NK cell) lines available in the art, may be used. In certain aspects of the present invention, T cells can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and to place the cells in an appropriate buffer or media for subsequent processing steps. In one aspect of the invention, the cells are washed with phosphate buffered saline (PBS). In an alternative aspect, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as CD3+, CD4+, CD8+, CD45RA+, and/or CD45RO+ T cells, can be further isolated by positive or negative selection techniques. For example, in one aspect, T cells are isolated by incubation with anti-CD3/anti-CD28 (e.g., 3×28)-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this invention. In certain aspects, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. In certain aspects, it may be desirable to enrich for or positively select for regulatory T cells which typically express CD4+, CD25+, CD62Lhi, GITR+, and FoxP3+. In certain aspects, it may be desirable to enrich for cells that are CD127low. Alternatively, in certain aspects, T regulatory cells are depleted by anti-C25 conjugated beads or other similar method of selection.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6\times10^9$ CD25+ T cells. In other aspects, the population of immune effector cells to be depleted include about $1\times10^9$ to $1\times10^{10}$ CD25+ T cell, and any integer value in between. In one embodiment, the resulting population T regulatory depleted cells has $2\times10^9$T regulatory cells, e.g., CD25+ cells, or less (e.g., $1\times10^9$, $5\times10^8$, $1\times10^8$, $5\times10^7$, $1\times10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR beta. In embodiments, the checkpoint inhibitor is PD1 or PD-L1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 2 billion cells/ml is used. In one aspect, a concentration of 1 billion cells/ml is used. In a further aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is 5×10e6/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as immune effector cells, e.g., T cells or NK cells, isolated and frozen for later use in cell therapy, e.g., T cell therapy, for any number of diseases or conditions that would benefit from cell therapy, e.g., T cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the immune effector cells (e.g., T cells or NK cells) may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Modifications of CAR Cells, Including Allogeneic CAR Cells

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II, and/or beta-2 microglobulin ($\beta_2$m). Compositions of allogeneic CAR and methods thereof have been described in, e.g., pages 227-237 of WO 2016/014565, incorporated herein by reference in its entirety.

In some embodiments, a cell, e.g., a T cell or a NK cell, is modified to reduce the expression of a TCR, and/or HLA, and/or $\beta_2$m, and/or an inhibitory molecule described herein (e.g., PD1, PD-L1, PD-L2, CTLA4, TIM3, CEACAM (e.g., CEACAM-i, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR beta), using, e.g., a method described herein, e.g., siRNA, shRNA, clustered regularly interspaced short palindromic repeats (CRISPR) transcription-activator like effector nuclease (TALEN), or zinc finger endonuclease (ZFN).

In some embodiments, a cell, e.g., a T cell or a NK cell is engineered to express a telomerase subunit, e.g., the catalytic subunit of telomerase, e.g., TERT, e.g., hTERT. In one embodiment, such modification improves persistence of the cell in a patient.

Activation and Expansion of T Cells

T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Generally, the T cells of the invention may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., Transplant Proc. 30(8):3975-3977, 1998; Haanen et al., J. Exp. Med. 190(9):13191328, 1999; Garland et al., J Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect of the present invention, more anti-CD28 antibody is bound to the particles than anti-CD3 antibody, i.e., the ratio of CD3:CD28 is less than one. In certain aspects of the invention, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects of the present invention, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one aspect of the present invention, the mixture may be cultured for several hours (about 3 hours) to about 14 days or any hourly integer value in between. In one aspect, the mixture may be cultured for 21 days. In one aspect of the invention the beads and the T cells are cultured together for about eight days. In one aspect, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., CAR-expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population. Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CAR is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CAR are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of $CAR^+$ T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with antigen-expressing cells, such as multiple myeloma cell lines or K562 expressing the antigen, following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human antigen-specific $CAR^+$ T cells to treat a primary human multiple myeloma in immunodeficient mice can be used. See, e.g., Milone et al., Molecular Therapy 17(8): 1453-1464 (2009). Very briefly, after establishment of MM, mice are randomized as to treatment groups. Different numbers of CART cells can be injected into immunodeficient mice bearing MM Animals are assessed for disease progression and tumor burden at weekly intervals. Survival curves for the groups are compared using the log-rank test. In addition, absolute peripheral blood $CD4^+$ and $CD8^+$ T cell counts 4 weeks following T cell injection in the immunodeficient mice can also be analyzed. Mice are injected with multiple myeloma cells and 3 weeks later are injected with T cells engineered to express CAR, e.g., by a bicistronic lentiviral vector that encodes the CAR linked to eGFP. T cells are normalized to 45-50% input $GFP^+$ T cells by mixing with mock-transduced cells prior to injection, and confirmed by flow cytometry. Animals are assessed for leukemia at 1-week intervals. Survival curves for the $CAR^+$ T cell groups are compared using the log-rank test.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing the antigen or other antigen-expressing myeloma cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term $CD8^+$ T cell expansion ex vivo. T cells are enumerated in cultures using CountBright™ fluorescent beads (Invitrogen, Carlsbad, CA) and flow cytometry as described by the manufacturer. CAR+ T cells are identified by GFP expression using T cells that are engineered with eGFP-2A linked CAR-expressing lentiviral vectors. For CAR+ T cells not expressing GFP, the CAR+ T cells are detected with biotinylated recombinant antigen protein and a secondary avidin-PE conjugate. CD4+ and $CD8^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, CA) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (e.g., K562 lines expressing the antigen and primary multiple myeloma cells) are loaded with 51Cr (as NaCrO4, New England Nuclear, Boston, MA) at 37° C. for 2 hours with frequent agitation, washed twice in complete RPMI and plated into microtiter plates. Effector T cells are mixed with target cells in the wells in complete RPMI at varying ratios of effector cell: target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, MA). Each condition is performed in at least triplicate, and the percentage of lysis is calculated using the formula: % Lysis=(ER−SR)/(TR−SR), where ER represents the average 51Cr released for each experimental condition. Alternatively, cytotoxicity can also be assessed using a Bright-Glo™ Luciferase Assay.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/$\gamma c^{-/-}$ (NSG) mice or other immunodeficient are injected IV with multiple myeloma cells followed 7 days later with CART cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of $CAR^+$ T cells in a multiple myeloma xenograft model can be measured as the following: NSG mice are injected with multiple myeloma cells transduced to stably express firefly luciferase, followed by a single tail-vein injection of T cells electroporated with CAR construct days later. Animals are imaged at various time points post injection. For example, photon-density heat maps of firefly luciferasepositive tumors in representative mice at day 5 (2 days before treatment) and day 8 (24 hr post $CAR^+$ PBLs) can be generated.

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain) In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

- providing the CAR ligand (optionally, a labelled CAR ligand, e.g., a CAR ligand that includes a tag, a bead, a radioactive or fluorescent label);
- acquiring the CAR-expressing cell (e.g., acquiring a sample containing CAR-expressing cells, such as a manufacturing sample or a clinical sample);
- contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

- providing a CAR-expressing cell (e.g., a first CAR-expressing cell or a transiently expressing CAR cell);
- contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In one embodiment, the anti-idiotypic antibody molecule recognizes an anti-CD19 antibody molecule, e.g., an anti-CD19 scFv. For instance, the anti-idiotypic antibody molecule can compete for binding with the CD19-specific CAR mAb clone no. 136.20.1 described in Jena et al., PLOS March 2013 8:3 e57838; may have the same CDRs (e.g., one or more of, e.g., all of, VH CDR1, VH CDR2, CH CDR3, VL CDR1, VL CDR2, and VL CDR3, using the Kabat definition, the Chothia definition, or a combination of tthe Kabat and Chothia definitions) as the CD19-specific CAR mAb clone no. 136.20.1; may have one or more (e.g., 2) variable regions as the CD19-specific CAR mAb clone no. 136.20.1, or may comprise the CD19-specific CAR mAb clone no. 136.20.1. In some embodiments, the anti-idiotypic antibody was made according to a method described in Jena et al. In another embodiment, the anti-idiotypic antibody molecule is an anti-idiotypic antibody molecule described in WO 2014/190273. In some embodiments, the anti-idiotypic antibody molecule has the same CDRs (e.g., one or more of, e.g., all of, VH CDR1, VH CDR2, CH CDR3, VL CDR1, VL CDR2, and VL CDR3) as an antibody molecule of WO 2014/190273 such as 136.20.1; may have one or more (e.g., 2) variable regions of an antibody molecule of WO 2014/190273, or may comprise an antibody molecule of WO 2014/190273 such as 136.20.1. In other embodiments, the anti-CAR antibody binds to a constant region of the extracellular binding domain of the CAR molecule, e.g., as described in WO 2014/190273. In some embodiments, the anti-CAR antibody binds to a constant region of the extracellular binding domain of the CAR molecule, e.g., a heavy chain constant region (e.g., a CH2-CH3 hinge region) or light chain constant region. For instance, in some embodiments the anti-CAR antibody competes for binding with the 2D3 monoclonal antibody described in WO 2014/190273, has the same CDRs (e.g., one or more of, e.g., all of, VH CDR1, VH CDR2, CH CDR3, VL CDR1, VL CDR2, and VL CDR3) as 2D3, or has one or more (e.g., 2) variable regions of 2D3, or comprises 2D3 as described in WO 2014/190273.

In some aspects and embodiments, the compositions and methods herein are optimized for a specific subset of T cells, e.g., as described in U.S. Ser. No. 62/031,699 filed Jul. 31, 2014, the contents of which are incorporated herein by reference in their entirety. In some embodiments, the optimized subsets of T cells display an enhanced persistence compared to a control T cell, e.g., a T cell of a different type (e.g., $CD8^+$ or $CD4^+$) expressing the same construct.

In some embodiments, a $CD4^+$ T cell comprises a CAR described herein, which CAR comprises an intracellular signaling domain suitable for (e.g., optimized for, e.g., leading to enhanced persistence in) a $CD4^+$ T cell, e.g., an ICOS domain. In some embodiments, a $CD8^+$ T cell comprises a CAR described herein, which CAR comprises an intracellular signaling domain suitable for (e.g., optimized for, e.g., leading to enhanced persistence of) a $CD8^+$ T cell, e.g., a 4-1BB domain, a CD28 domain, or another costimulatory domain other than an ICOS domain.

In an aspect, described herein is a method of treating a subject, e.g., a subject having cancer. The method includes administering to said subject, an effective amount of:

1) a $CD4^+$ T cell comprising a CAR (the $CAR^{CD4+}$) comprising:
 an antigen binding domain, e.g., an antigen binding domain described herein;
 a transmembrane domain; and
 an intracellular signaling domain, e.g., a first costimulatory domain, e.g., an ICOS domain; and 2) a $CD8^+$ T cell comprising a CAR (the $CAR^{CD8+}$) comprising:
 an antigen binding domain, e.g., an antigen binding domain described herein;
 a transmembrane domain; and
 an intracellular signaling domain, e.g., a second costimulatory domain, e.g., a 4-1BB domain, a CD28 domain, or another costimulatory domain other than an ICOS domain;
 wherein the $CAR^{CD4+}$ and the $CAR^{CD8+}$ differ from one another.

Optionally, the method further includes administering:

3) a second CD8+ T cell comprising a CAR (the second $CAR^{CD8+}$) comprising:
 an antigen binding domain, e.g., an antigen binding domain described herein;
 a transmembrane domain; and
 an intracellular signaling domain, wherein the second $CAR^{CD8+}$ comprises an intracellular signaling domain, e.g., a costimulatory signaling domain, not present on the $CAR^{CD8+}$, and, optionally, does not comprise an ICOS signaling domain.

Other assays, including those that are known in the art can also be used to evaluate the CAR constructs of the invention.

Therapeutic Application

Methods Using Biomarkers for Evaluating CAR-Effectiveness, Subject Suitability, or Sample Suitability In another aspect, the invention features a method of evaluating or monitoring the effectiveness of a CAR-expressing cell therapy in a subject (e.g., a subject having a cancer). The method includes acquiring a value of effectiveness to the CAR therapy, subject suitability, or sample suitability, wherein said value is indicative of the effectiveness or suitability of the CAR-expressing cell therapy.

In some embodiments of any of the methods disclosed herein, the subject is evaluated prior to receiving, during, or after receiving, the CAR-expressing cell therapy.

In some embodiments of any of the methods disclosed herein, a responder (e.g., a complete responder) has, or is identified as having, a greater level or activity of one, two, or more (all) of GZMK, PPF1BP2, or naïve T cells as compared to a non-responder.

In some embodiments of any of the methods disclosed herein, a non-responder has, or is identified as having, a greater level or activity of one, two, three, four, five, six, seven, or more (e.g., all) of IL22, IL-2RA, IL-21, IRF8, IL8, CCL17, CCL22, effector T cells, or regulatory T cells, as compared to a responder.

In an embodiment, a relapser is a patient having, or who is identified as having, an increased level of expression of one or more of (e.g., 2, 3, 4, or all of) the following genes, compared to non relapsers: MIR199A1, MIR1203, uc021ovp, ITM2C, and HLA-DQB1 and/or a decreased levels of expression of one or more of (e.g., 2, 3, 4, 5, 6, 7, 8, 9, 10, 11, or all of) the following genes, compared to non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

In some embodiments of any of the methods disclosed herein, a non-responder has, or is identified as having, a greater percentage of an immune cell exhaustion marker, e.g., one, two or more immune checkpoint inhibitors (e.g., PD-1, PD-L1, TIM-3 and/or LAG-3). In one embodiment, a non-responder has, or is identified as having, a greater percentage of PD-1, PD-L1, or LAG-3 expressing immune effector cells (e.g., CD4+ T cells and/or CD8+ T cells) (e.g., CAR-expressing CD4+ cells and/or CD8+ T cells) compared to the percentage of PD-1 or LAG-3 expressing immune effector cells from a responder.

In one embodiment, a non-responder has, or is identified as having, a greater percentage of immune cells having an exhausted phenotype, e.g., immune cells that co-express at least two exhaustion markers, e.g., co-expresses PD-1, PD-L1 and/or TIM-3. In other embodiments, a non-responder has, or is identified as having, a greater percentage of immune cells having an exhausted phenotype, e.g., immune cells that co-express at least two exhaustion markers, e.g., co-expresses PD-1 and LAG-3.

In some embodiments of any of the methods disclosed herein, a non-responder has, or is identified as having, a greater percentage of PD-1/PD-L1+/LAG-3+ cells in the CAR-expressing cell population compared to a responder (e.g., a complete responder) to the CAR-expressing cell therapy.

In some embodiments of any of the methods disclosed herein, a partial responder has, or is identified as having, a higher percentages of PD-1/PD-L1+/LAG-3+ cells, than a responder, in the CAR-expressing cell population.

In some embodiments of any of the methods disclosed herein, a non-responder has, or is identified as having, an exhausted phenotype of PD1/PD-L1+ CAR+ and co-expression of LAG3 in the CAR-expressing cell population.

In some embodiments of any of the methods disclosed herein, a non-responder has, or is identified as having, a greater percentage of PD-1/PD-L1+/TIM-3+ cells in the CAR-expressing cell population compared to the responder (e.g., a complete responder).

In some embodiments of any of the methods disclosed herein, a partial responders has, or is identified as having, a higher percentage of PD-1/PD-L1+/TIM-3+ cells, than responders, in the CAR-expressing cell population.

In some embodiments of any of the methods disclosed herein, the presence of CD8+ CD27+ CD45RO− T cells in an apheresis sample is a positive predictor of the subject response to a CAR-expressing cell therapy.

In some embodiments of any of the methods disclosed herein, a high percentage of PD1+ CAR+ and LAG3+ or TIM3+ T cells in an apheresis sample is a poor prognostic predictor of the subject response to a CAR-expressing cell therapy.

In some embodiments of any of the methods disclosed herein, the responder (e.g., the complete or partial responder) has one, two, three or more (or all) of the following profile:

(i) has a greater number of CD27+ immune effector cells compared to a reference value, e.g., a non-responder number of CD27+ immune effector cells;

(ii) has a greater number of CD8+ T cells compared to a reference value, e.g., a non-responder number of CD8+ T cells;

(iii) has a lower number of immune cells expressing one or more checkpoint inhibitors, e.g., a checkpoint inhibitor chosen from PD-1, PD-L1, LAG-3, TIM-3, or KLRG-1, or a combination, compared to a reference value, e.g., a non-responder number of cells expressing one or more checkpoint inhibitors; or (iv) has a greater number of one, two, three, four or more (all) of resting $T_{EFF}$ cells, resting $T_{REG}$ cells, naïve CD4 cells, unstimulated memory cells or early memory T cells, or a combination thereof, compared to a reference value, e.g., a non-responder number of resting $T_{EFF}$ cells, resting $T_{REG}$ cells, naïve CD4 cells, unstimulated memory cells or early memory T cells.

In some embodiments of any of the methods disclosed herein, the cytokine level or activity of (vi) is chosen from one, two, three, four, five, six, seven, eight, or more (or all) of cytokine CCL20/MIP3a, IL17A, IL6, GM-CSF, IFN-γ, IL10, IL13, IL2, IL21, IL4, IL5, IL9 or TNFα, or a combination thereof. The cytokine can be chosen from one, two, three, four or more (all) of IL-17a, CCL20, IL2, IL6, or TNFα. In one embodiment, an increased level or activity of a cytokine is chosen from one or both of IL-17a and CCL20, is indicative of increased responsiveness or decreased relapse.

In embodiments, the responder, a non-responder, a relapser or a non-relapser identified by the methods herein can be further evaluated according to clinical criteria. For example, a complete responder has, or is identified as, a subject having a disease, e.g., a cancer, who exhibits a complete response, e.g., a complete remission, to a treatment. A complete response may be identified, e.g., using the NCCN Guidelines®, or Cheson et al, J Clin Oncol 17:1244 (1999) and Cheson et al., "Revised Response Criteria for Malignant Lymphoma", J Clin Oncol 25:579-586 (2007) (both of which are incorporated by reference herein in their entireties), as described herein. A partial responder has, or is identified as, a subject having a disease, e.g., a cancer, who exhibits a partial response, e.g., a partial remission, to a treatment. A partial response may be identified, e.g., using the NCCN Guidelines®, or Cheson criteria as described herein. A non-responder has, or is identified as, a subject having a disease, e.g., a cancer, who does not exhibit a response to a treatment, e.g., the patient has stable disease or progressive disease. A non-responder may be identified, e.g., using the NCCN Guidelines®, or Cheson criteria as described herein.

Alternatively, or in combination with the methods disclosed herein, responsive to said value, performing one, two, three four or more of:

administering e.g., to a responder or a non-relapser, a CAR-expressing cell therapy;

administered an altered dosing of a CAR-expressing cell therapy;

altering the schedule or time course of a CAR-expressing cell therapy;

administering, e.g., to a non-responder or a partial responder, an additional agent in combination with a CAR-expressing cell therapy, e.g., a checkpoint inhibitor, e.g., a checkpoint inhibitor described herein;

administering to a non-responder or partial responder a therapy that increases the number of younger T cells in the subject prior to treatment with a CAR-expressing cell therapy;

modifying a manufacturing process of a CAR-expressing cell therapy, e.g., enriching for younger T cells prior to introducing a nucleic acid encoding a CAR, or increasing the transduction efficiency, e.g., for a subject identified as a non-responder or a partial responder;

administering an alternative therapy, e.g., for a non-responder or partial responder or relapser; or if the subject is, or is identified as, a non-responder or a relapser, decreasing the $T_{REG}$ cell population and/or $T_{REG}$ gene signature, e.g., by one or more of CD25 depletion, administration of cyclophosphamide, anti-GITR antibody, or a combination thereof.

In certain embodiments, the subject is pre-treated with an anti-GITR antibody. In certain embodiment, the subject is treated with an anti-GITR antibody prior to infusion or re-infusion.

Combination Therapies

A CAR-expressing cell combined with an RNA molecule as described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell combined with an RNA molecule as described herein and the at least one additional therapeutic agent can be administered simultaneously, in the same or in separate compositions, or sequentially. For sequential administration, the CAR-expressing cell combined with an RNA molecule as described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In some embodiments, the invention discloses a combination therapy including a CAR-expressing cell therapy described herein, an RNA molecule (e.g., an exogenous RNA molecule) described herein (or a nucleic acid molecule (e.g., an exogenous nucleic acid molecule) encoding the RNA molecule), and an additional therapeutic agent.

PD-1 Inhibitor

In some embodiments, the additional therapeutic agent is a PD-1 inhibitor. In some embodiments, the PD-1 inhibitor is chosen from PDR001 (Novartis), Nivolumab (Bristol-Myers Squibb), Pembrolizumab (Merck & Co), Pidilizumab (CureTech), MEDI0680 (Medimmune), REGN2810 (Regeneron), TSR-042 (Tesaro), PF-06801591 (Pfizer), BGB-A317 (Beigene), BGB-108 (Beigene), INCSHR1210 (Incyte), or AMP-224 (Amplimmune).

In one embodiment, the PD-1 inhibitor is an anti-PD-1 antibody molecule. In one embodiment, the PD-1 inhibitor is an anti-PD-1 antibody molecule as described in US 2015/0210769, published on Jul. 30, 2015, entitled "Antibody Molecules to PD-1 and Uses Thereof," incorporated by reference in its entirety. In one embodiment, the anti-PD-1 antibody molecule comprises the CDRs, variable regions, heavy chains and/or light chains of BAP049-Clone-E or BAP049-Clone-B disclosed in US 2015/0210769. The antibody molecules described herein can be made by vectors, host cells, and methods described in US 2015/0210769, incorporated by reference in its entirety.

In one embodiment, the anti-PD-1 antibody molecule is Nivolumab (Bristol-Myers Squibb), also known as MDX-1106, MDX-1106-04, ONO-4538, BMS-936558, or OPDIVO®. Nivolumab (clone 5C4) and other anti-PD-1 antibodies are disclosed in U.S. Pat. No. 8,008,449 and WO 2006/121168, incorporated by reference in their entirety. In one embodiment, the anti-PD-1 antibody molecule is Pembrolizumab (Merck & Co), also known as Lambrolizumab, MK-3475, MK03475, SCH-900475, or KEYTRUDA®. Pembrolizumab and other anti-PD-1 antibodies are disclosed in Hamid, O. et al. (2013) *New England Journal of Medicine* 369 (2): 134-44, U.S. Pat. No. 8,354,509, and WO 2009/114335, incorporated by reference in their entirety. In one embodiment, the anti-PD-1 antibody molecule is Pidilizumab (CureTech), also known as CT-011. Pidilizumab and other anti-PD-1 antibodies are disclosed in Rosenblatt, J. et al. (2011) *J Immunotherapy* 34(5): 409-18, U.S. Pat. Nos. 7,695,715, 7,332,582, and 8,686,119, incorporated by reference in their entirety. In one embodiment, the anti-PD-1 antibody molecule is MEDI0680 (Medimmune), also known as AMP-514. MEDI0680 and other anti-PD-1 antibodies are disclosed in U.S. Pat. No. 9,205,148 and WO 2012/145493, incorporated by reference in their entirety. In one embodiment, the anti-PD-1 antibody molecule is REGN2810 (Regeneron). In one embodiment, the anti-PD-1 antibody molecule is PF-06801591 (Pfizer). In one embodiment, the anti-PD-1 antibody molecule is BGB-A317 or BGB-108 (Beigene). In one embodiment, the anti-PD-1 antibody molecule is INCSHR1210 (Incyte), also known as INCSHR01210 or SHR-1210. In one embodiment, the anti-PD-1 antibody molecule is TSR-042 (Tesaro), also known as ANB011.

Further known anti-PD-1 antibody molecules include those described, e.g., in WO 2015/112800, WO 2016/092419, WO 2015/085847, WO 2014/179664, WO 2014/194302, WO 2014/209804, WO 2015/200119, U.S. Pat. Nos. 8,735,553, 7,488,802, 8,927,697, 8,993,731, and 9,102,727, incorporated by reference in their entirety.

In one embodiment, the PD-1 inhibitor is a peptide that inhibits the PD-1 signaling pathway, e.g., as described in U.S. Pat. No. 8,907,053, incorporated by reference in its entirety. In one embodiment, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In one embodiment, the PD-1 inhibitor is AMP-224 (B7-DCIg (Amplimmune), e.g., disclosed in WO 2010/027827 and WO 2011/066342, incorporated by reference in their entirety).

PD-L1 Inhibitors

In some embodiments, the additional therapeutic agent is a PD-L1 inhibitor. In some embodiments, the PD-L1 inhibitor is chosen from FAZ053 (Novartis), Atezolizumab (Genentech/Roche), Avelumab (Merck Serono and Pfizer), Durvalumab (MedImmune/AstraZeneca), or BMS-936559 (Bristol-Myers Squibb).

In one embodiment, the PD-L1 inhibitor is an anti-PD-L1 antibody molecule. In one embodiment, the PD-L1 inhibitor is an anti-PD-L1 antibody molecule as disclosed in US 2016/0108123, published on Apr. 21, 2016, entitled "Antibody Molecules to PD-L1 and Uses Thereof," incorporated by reference in its entirety. In one embodiment, the anti-PD-L1 antibody molecule comprises the CDRs, variable regions, heavy chains and/or light chains of BAP058-Clone O or BAP058-Clone N disclosed in US 2016/0108123.

In one embodiment, the anti-PD-L1 antibody molecule is Atezolizumab (Genentech/Roche), also known as MPDL3280A, RG7446, RO5541267, YW243.55.570, or TECENTRIQ™. Atezolizumab and other anti-PD-L1 antibodies are disclosed in U.S. Pat. No. 8,217,149, incorporated by reference in its entirety. In one embodiment, the anti-PD-L1 antibody molecule is Avelumab (Merck Serono and Pfizer), also known as MSB0010718C. Avelumab and other anti-PD-L1 antibodies are disclosed in WO 2013/079174, incorporated by reference in its entirety. In one embodiment, the anti-PD-L1 antibody molecule is Durvalumab (MedImmune/AstraZeneca), also known as MEDI4736. Durvalumab and other anti-PD-L1 antibodies are disclosed in U.S. Pat. No. 8,779,108, incorporated by reference in its entirety. In one embodiment, the anti-PD-L1 antibody molecule is BMS-936559 (Bristol-Myers Squibb), also known as MDX-1105 or 12A4. BMS-936559 and other anti-PD-L1 antibodies are disclosed in U.S. Pat. No. 7,943,743 and WO 2015/081158, incorporated by reference in their entirety.

Further known anti-PD-L1 antibodies include those described, e.g., in WO 2015/181342, WO 2014/100079, WO 2016/000619, WO 2014/022758, WO 2014/055897, WO 2015/061668, WO 2013/079174, WO 2012/145493, WO 2015/112805, WO 2015/109124, WO 2015/195163, U.S. Pat. Nos. 8,168,179, 8,552,154, 8,460,927, and 9,175,082, incorporated by reference in their entirety.

LAG-3 Inhibitors

In some embodiments, the additional therapeutic agent is a LAG-3 inhibitor. In some embodiments, the LAG-3 inhibitor is chosen from LAG525 (Novartis), BMS-986016 (Bristol-Myers Squibb), or TSR-033 (Tesaro).

In one embodiment, the LAG-3 inhibitor is an anti-LAG-3 antibody molecule. In one embodiment, the LAG-3 inhibitor is an anti-LAG-3 antibody molecule as disclosed in US 2015/0259420, published on Sep. 17, 2015, entitled "Antibody Molecules to LAG-3 and Uses Thereof," incorporated by reference in its entirety. In one embodiment, the anti-LAG-3 antibody molecule comprises the CDRs, variable regions, heavy chains and/or light chains of BAP050-Clone I or BAP050-Clone J disclosed in US 2015/0259420.

In one embodiment, the anti-LAG-3 antibody molecule is BMS-986016 (Bristol-Myers Squibb), also known as BMS986016. BMS-986016 and other anti-LAG-3 antibodies are disclosed in WO 2015/116539 and U.S. Pat. No. 9,505,839, incorporated by reference in their entirety. In one embodiment, the anti-LAG-3 antibody molecule is TSR-033 (Tesaro). In one embodiment, the anti-LAG-3 antibody molecule is IMP731 or GSK2831781 (GSK and Prima BioMed). IMP731 and other anti-LAG-3 antibodies are disclosed in WO 2008/132601 and U.S. Pat. No. 9,244,059, incorporated by reference in their entirety. In one embodiment, the anti-LAG-3 antibody molecule is IMP761 (Prima BioMed).

Further known anti-LAG-3 antibodies include those described, e.g., in WO 2008/132601, WO 2010/019570, WO 2014/140180, WO 2015/116539, WO 2015/200119, WO 2016/028672, U.S. Pat. Nos. 9,244,059, 9,505,839, incorporated by reference in their entirety.

In one embodiment, the anti-LAG-3 inhibitor is a soluble LAG-3 protein, e.g., IMP321 (Prima BioMed), e.g., as disclosed in WO 2009/044273, incorporated by reference in its entirety.

TIM-3 Inhibitors

In some embodiments, the additional therapeutic agent is a TIM-3 inhibitor. In some embodiments, the TIM-3 inhibitor is MGB453 (Novartis) or TSR-022 (Tesaro).

In one embodiment, the TIM-3 inhibitor is an anti-TIM-3 antibody molecule. In one embodiment, the TIM-3 inhibitor is an anti-TIM-3 antibody molecule as disclosed in US 2015/0218274, published on Aug. 6, 2015, entitled "Antibody Molecules to TIM-3 and Uses Thereof," incorporated by reference in its entirety. In one embodiment, the anti-TIM-3 antibody molecule comprises the CDRs, variable regions, heavy chains and/or light chains of ABTIM3-hum11 or ABTIM3-hum03 disclosed in US 2015/0218274.

In one embodiment, the anti-TIM-3 antibody molecule is TSR-022 (AnaptysBio/Tesaro). In one embodiment, the anti-TIM-3 antibody molecule comprises one or more of the CDR sequences (or collectively all of the CDR sequences), the heavy chain or light chain variable region sequence, or the heavy chain or light chain sequence of APE5137 or APE5121. APE5137, APE5121, and other anti-TIM-3 antibodies are disclosed in WO 2016/161270, incorporated by reference in its entirety. In one embodiment, the anti-TIM-3 antibody molecule is the antibody clone F38-2E2.

Further known anti-TIM-3 antibodies include those described, e.g., in WO 2016/111947, WO 2016/071448, WO 2016/144803, U.S. Pat. Nos. 8,552,156, 8,841,418, and 9,163,087, incorporated by reference in their entirety.

Inhibitors of a Pro-M2 Macrophage Molecule

In some embodiments, the additional therapeutic agent is an inhibitor of a pro-M2 macrophage molecule. Macrophages with the M2 phenotype are known to play a role in inhibiting T cell function, including cytotoxic function. Certain cytokines, such as IL-13, IL-4, IL-10, CSF-1, TGF-beta and GM-CSF are known to polarize macrophages to the M2 phenotype, for example (in the case of IL-13 and/or IL-4), by interaction with the IL-13Rα1 chain and/or IL-4Rα chain expressed on macrophages. Molecules that block such molecules are useful in the methods and compositions described herein. Exemplary inhibitors of a pro-M2 macrophage molecule include inhibitors of IL-13, inhibitors of IL-4, inhibitors of IL-13Rα1, and/or inhibitors of IL-4Ra, e.g., as described herein.

Inhibitors of a pro-M2 macrophage molecule include, for example, small molecules. An example of a small molecule inhibitor that can be administered with a CAR-expressing cell disclosed herein and an RNA molecule disclosed herein is pterostilbene (see, e.g., Huang et al., Oncotarget. 2016 Jun. 28; 7(26): 39363-39375), which is hereby incorporated by reference in its entirety.

Inhibitors of a pro-M2 macrophage molecule include, for example, an antibody molecule, a polypeptide, e.g., a fusion protein, or an inhibitory nucleic acid, e.g., a siRNA or shRNA, or a CAR-expressing cell which binds one or more surface antigens on MDSCs or TAMs.

In one aspect, the inhibitor of a pro-M2 macrophage molecule is an anti-IL-13 antibody. Generation of such antibodies may be undertaken by methods known in the art. An example of anti-IL-13 antibodies includes, for example, lebrikizumab (see CAS number 953400-68-5). Another example of an anti-IL-13 antibody is tralokinumab (CAS number 1044515-88-9). Another example of an anti-IL-13 antibody is or comprises the anti-IL-13 binding domain of GSK2434735. Another example of an anti-IL-13 antibody is QAX576 (see, e.g., Rothenberg et al., *J. Allergy Clin. Immunol.,* 2015, 135(2), pp. 500-507, which is hereby incorporated by reference in its entirety).

In another aspect, the inhibitor of a pro-M2 macrophage molecule is an anti-IL-4 antibody or anti-IL-4Rα antibody. Generation of such antibodies may be undertaken by methods known in the art. An example of anti-IL-4 antibodies includes, for example, the anti-IL-4 binding domain of GSK2434735. Another example of an anti-IL-4 antibody is, for example, dupilumab (see CAS number 1190264-60-8).

In another embodiment, the inhibitor of a pro-M2 macrophage is an inhibitor of IL-13 and/or IL-4. An example of an inhibitor of IL-13 and IL-4 that can be administered with a CAR-expressing cell disclosed herein and an RNA molecule disclosed herein is the vitamin A derivative Fenretinide ((e.g., 4-HPR) see, e.g., Dong et al. Cancer Letters. Mar. 1, 2017. Volume 388, Pages 43-53, which is hereby incorporated by reference in its entirety).

In another aspect, the inhibitor of a pro-M2 macrophage molecule is an anti-CSF-1 antibody or small molecule inhibitor of CSF-1. Generation of such antibodies may be undertaken by methods known in the art. An example of an anti-CSF-1 antibody is emactuzumab. Another example of a CSF-1 inhibitor is BLZ945 (see, e.g., Strachan, D C et al., Oncoimmunology, 2013 Dec. 1, 2(12): e26968, which is hereby incorporated by reference in its entirety). Another example of an inhibitor of CSF-1 that can be administered with a CAR-expressing cell disclosed herein and an RNA molecule disclosed herein is nintedanib (see, e.g., Tandon et al. American Journal of Respiratory and Critical Care Medicine 2017; 195:A2397, which is hereby incorporated by reference in its entirety).

BLZ945 is a small molecule inhibitor of colony stimulating factor 1 receptor (CSF1R). See, e.g., Pyonteck et al. Nat. Med. 19(2013):1264-72. In embodiments the CAR targets mesothelin, e.g., comprises a mesothelin binding domain described herein, e.g., is a CAR of Table 10, e.g., is M5. In embodiments the CAR targets EGFRvIII, e.g., comprises an EGFRvIII binding domain described herein, e.g., is a CAR of Table 9. The structure of BLZ945 is shown below.

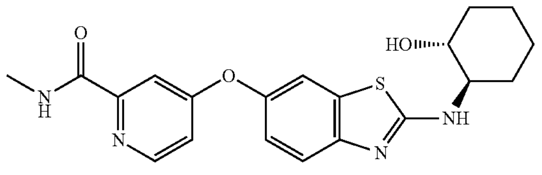 [SMILES: CNC(=O)c1cc(Oc2ccc3nc(N[C@@H]4CCCC[C@H]4O)sc3c2)ccn1]

In another aspect, the inhibitor of a pro-M2 macrophage molecule is a CAR-expressing cell which binds an antigen expressed on the surface of a MDSC or TAM (i.e., a TAM antigen), e.g., an antigen that is upregulated on the surface of a MDSCs or TAM, relative to other macrophages. In embodiments, the CAR-expressing cell which binds a MDSCs or TAM antigen binds to CD123. In embodiments, the CAR-expressing cell which binds a MDSCs or TAM antigen binds to CSF1R. In embodiments, the CAR-expressing cell which binds a MDSCs or TAM antigen binds to CD68. In embodiments, the CAR-expressing cell which binds a MDSCs or TAM antigen binds to CD206.

In another embodiment, the inhibitor of a pro-M2 macrophage is a JAK2 inhibitor. An example of a JAK2 inhibitor that can be administered with a CAR-expressing cell disclosed herein and an RNA molecule disclosed herein is Ruxolitinib (see, e.g., Chen et al. Clinical Lymphoma, Myeloma and Leukemia, Volume 17, Issue 1, e93, 2017, which is hereby incorporated by reference in its entirety).

In another embodiment, the inhibitor of a pro-M2 macrophage molecule is a cell surface molecule. An example of a cell surface molecule that can be administered with a CAR-expressing cell disclosed herein and an RNA molecule disclosed herein is Dipeptidyl peptidase 4 (DPP-4) or CD26 (see, e.g., Zhuge et al. Diabetes 2016 October; 65(10): 2966-2979, which is hereby incorporated by reference in its entirety).

In another embodiment, the inhibitor of a pro-M2 macrophage molecule is an HDAC inhibitor. An example of an HDAC inhibitor that can be administered with a CAR-expressing cell disclosed herein and an RNA molecule disclosed herein is suberanilohydroxamic acid (SAHA).

In another embodiment, the inhibitor of a pro-M2 macrophage molecule is an inhibitor of the glycolytic pathway. An example of an inhibitor of the glycolytic pathway that can be administered with a CAR-expressing cell disclosed herein and an RNA molecule disclosed herein is 2-deoxy-d-glucose ((2-DG), see, e.g., Zanganeh, Nat Nanotechnol. 2016 November; 11(11): 986-994, which is hereby incorporated by reference in its entirety).

In another embodiment, the inhibitor of a pro-M2 macrophage molecule is a mitochondria-targeted antioxidant. An example of a mitochondria-targeted antioxidant that can be administered with a CAR-expressing cell disclosed herein and an RNA molecule disclosed herein is MitoQ (Formentini et al., Cell Reports, Volume 19, Issue 6, 9 May 2017, Pages 1202-1213, which is hereby incorporated by reference in its entirety).

In another embodiment, the inhibitor of a pro-M2 macrophage molecule is an iron oxide. An example of an iron oxide that can be administered with a CAR-expressing cell disclosed herein and an RNA molecule disclosed herein is ferumoxytol (see, e.g., Zanganeh, Nat Nanotechnol. 2016 November; 11(11): 986-994, which is hereby incorporated by reference in its entirety).

In embodiments, the invention includes a composition comprising an inhibitor of a pro-M2 macrophage molecule, and a pharmaceutically acceptable carrier.

Flt3 Ligand Polypeptide

In some embodiments, the additional therapeutic agent is a Fms-like tyrosine kinase 3 ligand (Flt3 ligand) polypeptide. Flt3 ligand is a cytokine that affects growth, survival, and/or differentiation of cells in the hematopoietic lineage. In combination with other growth factors, Flt3 ligand can stimulate proliferation and development of various cell types, including stem cells, myeloid and lymphoid precursor cells, dendritic cells and NK cells. Exemplary Flt3 ligand polypeptides are disclosed in U.S. Pat. Nos. 5,554,512, 6,291,661, 7,294,331, 7,361,330, and 9,486,519, incorporated herein by reference in their entirety.

Chemotherapeutic Agents

In some embodiments, the additional therapeutic agent is a chemotherapeutic agent. Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzamab, gemtuzumab, rituximab, tositumomab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R, 23S,24E, 26E,28Z,30S,32S,35R)-1,18-dihydroxy-19,30-dimethoxy-15,17,21,23, 29,35-hexamethyl-2,3,10,14,20-pentaoxo-11, 36-dioxa-4-azatricyclo[30.3.1.$0^{4,9}$] hexatriaconta-16,24,26, 28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and $N^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 846), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic.

Examples of suitable biopolymers include, but are not limited to, agar, agarose, alginate, alginate/calcium phosphate cement (CPC), beta-galactosidase (β-GAL), (1,2,3,4, 6-pentaacetyl a-D-galactose), cellulose, chitin, chitosan, collagen, elastin, gelatin, hyaluronic acid collagen, hydroxyapatite, poly(3-hydroxybutyrate-co-3-hydroxy-hexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., *Nature Biotechnology,* 2015, 33:97-101; and WO2014/110591.

Pharmaceutical Compositions and Treatments

Pharmaceutical compositions of the present invention may comprise a CAR-expressing cell, e.g., a plurality of CAR-expressing cells, combined with an RNA molecule as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated T cells to a subject and then subsequently redraw blood (or have an apheresis performed), activate T cells therefrom according to the present invention, and reinfuse the patient with these activated and expanded T cells. This process can be carried out multiple times every few weeks. In certain aspects, T cells can be activated from blood draws of from 10 cc to 400 cc. In certain aspects, T cells are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present invention are administered to a patient by intradermal or subcutaneous injection. In one aspect, the CAR-expressing cell (e.g., T cell or NK cell) compositions of the present invention are administered by i.v. injection. The compositions of CAR-expressing cells (e.g., T cells or NK cells) may be injected directly into a tumor, lymph node, or site of infection. In one aspect, the RNA molecule or the nucleic acid molecule encoding the RNA molecule disclosed herein is administered to a patient by intradermal or subcutaneous injection. In one aspect, the RNA molecule or the nucleic acid molecule encoding the RNA molecule disclosed herein is administered by i.v. injection. In one aspect, the RNA molecule or the nucleic acid molecule encoding the RNA molecule disclosed herein is injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., immune effector cells (e.g., T cells or NK cells). These immune effector cell (e.g., T cell or NK cell) isolates may be expanded by methods known in the art and treated such that one or more CAR constructs of the invention may be introduced, thereby creating a CAR-expressing cell (e.g., CAR T cell or CAR-expressing NK cell) of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cells (e.g., CAR T cells or NK cells) combined with an RNA molecule of the present invention. In an additional aspect, expanded cells combined with an RNA molecule described herein are administered before or following surgery.

In embodiments, lymphodepletion is performed on a subject, e.g., prior to administering one or more cells that express a CAR combined with an RNA molecule as described herein. In embodiments, the lymphodepletion comprises administering one or more of melphalan, cytoxan, cyclophosphamide, and fludarabine.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one embodiment, the CAR is introduced into immune effector cells (e.g., T cells or NK cells), e.g., using in vitro transcription, and the subject (e.g., human) receives an initial administration of CAR immune effector cells (e.g., T cells or NK cells) of the invention, and one or more subsequent administrations of the CAR immune effector cells (e.g., T cells or NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR immune effector cells (e.g., T cells or NK cells) of the invention are administered to the subject (e.g., human) per week, e.g., 2, 3, or 4 administrations of the CAR immune effector cells (e.g., T cells or NK cells) of the invention are administered per week. In one embodiment, the subject (e.g., human subject) receives more than one administration of the CAR immune effector cells (e.g., T cells or NK cells) per week (e.g., 2, 3 or 4 administrations per week) (also referred to herein as a cycle), followed by a week of no CAR immune effector cells (e.g., T cells or NK cells) administrations, and then one or more additional administration of the CAR immune effector cells (e.g., T cells or NK cells) (e.g., more than one administration of the CAR immune effector cells (e.g., T cells or NK cells) per week) is administered to the subject. In another embodiment, the subject (e.g., human subject) receives more than one cycle of CAR immune effector cells (e.g., T cells or NK cells), and the time between each cycle is less than 10, 9, 8, 7, 6, 5, 4, or 3 days. In one embodiment, the CAR immune effector cells (e.g., T cells or NK cells) are administered every other day for 3 administrations per week. In one embodiment, the CAR immune effector cells (e.g., T cells or NK cells) of the invention are administered for at least two, three, four, five, six, seven, eight or more weeks.

In one aspect, CAR-expressing cells (e.g., CARTs or CAR-expressing NK cells) are generated using lentiviral viral vectors, such as lentivirus. CAR-expressing cells (e.g., CARTs or CAR-expressing NK cells) generated that way will have stable CAR expression. In one aspect, this invention features a cell expressing a stimulatory RNA molecule, e.g., an immune stimulatory RNA molecule, disclosed herein, wherein the cell is generated using lentiviral viral vectors, such as lentivirus.

In one aspect, CAR-expressing cells, e.g., CARTs, are generated using a viral vector such as a gammaretroviral vector, e.g., a gammaretroviral vector described herein. CARTs generated using these vectors can have stable CAR expression. In one aspect, a cell expressing a stimulatory RNA molecule, e.g., an immune stimulatory RNA molecule, disclosed herein is generated using a viral vector such as a gammaretroviral vector, e.g., a gammaretroviral vector described herein.

In one aspect, CAR-expressing cells (e.g., CARTs or CAR-expressing NK cells) transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell, e.g., T cell or NK cell, by electroporation. In one aspect, a cell expressing a stimulatory RNA molecule, e.g., an immune stimulatory RNA molecule, disclosed herein transiently expresses the RNA molecule. In one aspect, the stimulatory RNA molecule is delivered into the cell by electroporation.

A potential issue that can arise in patients being treated using transiently expressing CAR-expressing cells (e.g., CARTs or CAR-expressing NK cells) (particularly with murine scFv bearing CAR-expressing cells (e.g., CARTs or CAR-expressing NK cells)) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen-day break in exposure to antigen.

If a patient is at high risk of generating an anti-CAR antibody response during the course of transient CAR therapy (such as those generated by RNA transductions), CAR-expressing cell (e.g., CART or CAR-expressing NK cell) infusion breaks should not last more than ten to fourteen days.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compositions of the present invention and practice the claimed methods. The following working examples specifically point out various aspects of the present invention, and are not to be construed as limiting in any way the remainder of the disclosure.

Example 1: Stimulatory RNA in the Tumor Microenvironment (TME) and Production by CAR T Cells Abstract Immune therapies have significantly improved outcomes for patients with poor prognosis in recent years, but are currently restricted to specific cancer types, and do not reach the majority of cancer patients. Thus, significant innovation is needed to extend the benefits of immune therapies to a significant patient population. The highly structured RNA RN7SL1 has recently been identified as capable of stimulating immune response genes in tumor cells following secretion by neighboring fibroblasts. Thus, unshielded RN7SL1 in the tumor microenvironment may represent a novel intratumoral immune stimulus that contributes to immune checkpoint blockade (ICB) responsiveness. It is shown here that RN7SL1 is stimulatory to primary human dendritic cells (DCs), and that increasing the amount of unshielded 7SL RNA present in the tumor microenvironment increases the frequency of intratumoral DCs and enhances T cell activation. Furthermore, this response is dependent on the signaling molecule MyD88, which is downstream of several TLRs, implicating innate immune recognition that leads to adaptive immune activation. Identification of patients with high levels of unshielded RN7SL1 by TCGA RNA sequencing data also correlates to enhanced immune infiltrate and gene signatures that are enriched in responders to anti-PD1 and anti-CTLA4 therapy. In order to deliver this stimulatory RNA, a T cell-based system was designed for delivering RN7SL1 directly to the tumor microenvironment. Using "synNotch" T cells, it was demonstrated that production of structured RNA activates primary human DCs and T cells in vitro. Additionally, to test this approach in vivo, a syngeneic system was developed for CAR T cell administration in which B16 melanoma expresses human CD19 as a model neoantigen that can be targeted by murine CAR T cells. The efficacy of CAR T cells was validated in this system, and the ability of synNotch CAR T cells to stimulate endogenous immune responses that control solid tumors more effectively will be tested. In total, this creates a framework for assaying the importance of a novel intratumoral damage-associated molecular pattern (DAMP) while improving the immunogenicity of CAR T cells in solid tumors.

TCGA Data Reflects Experimental Changes Observed in Murine Models

Figure 1C:
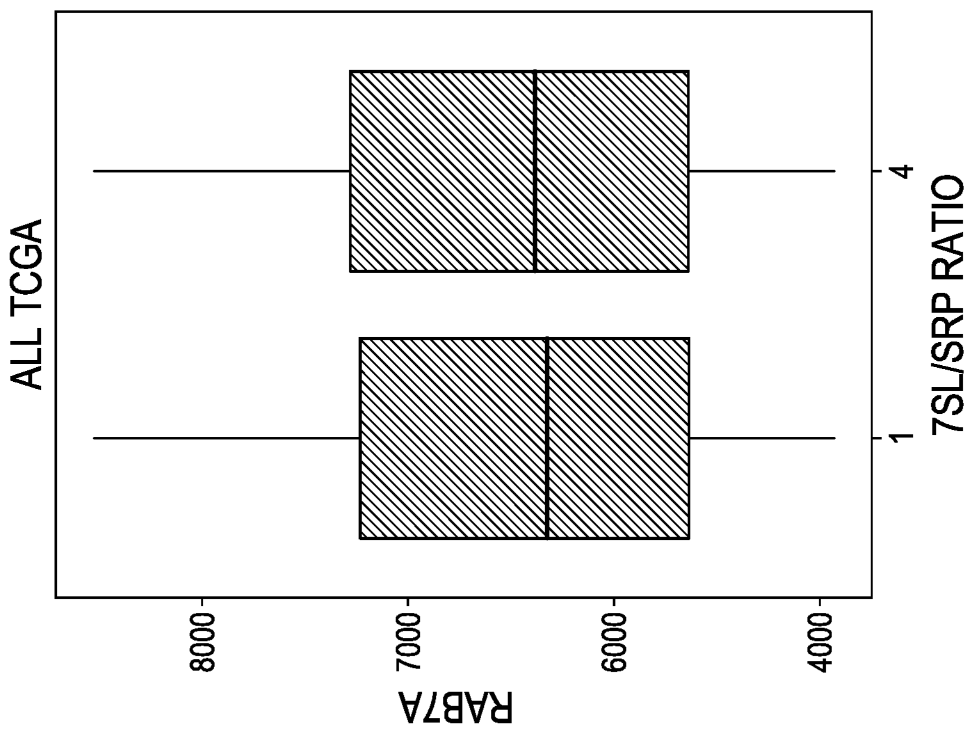
Figure 1B:
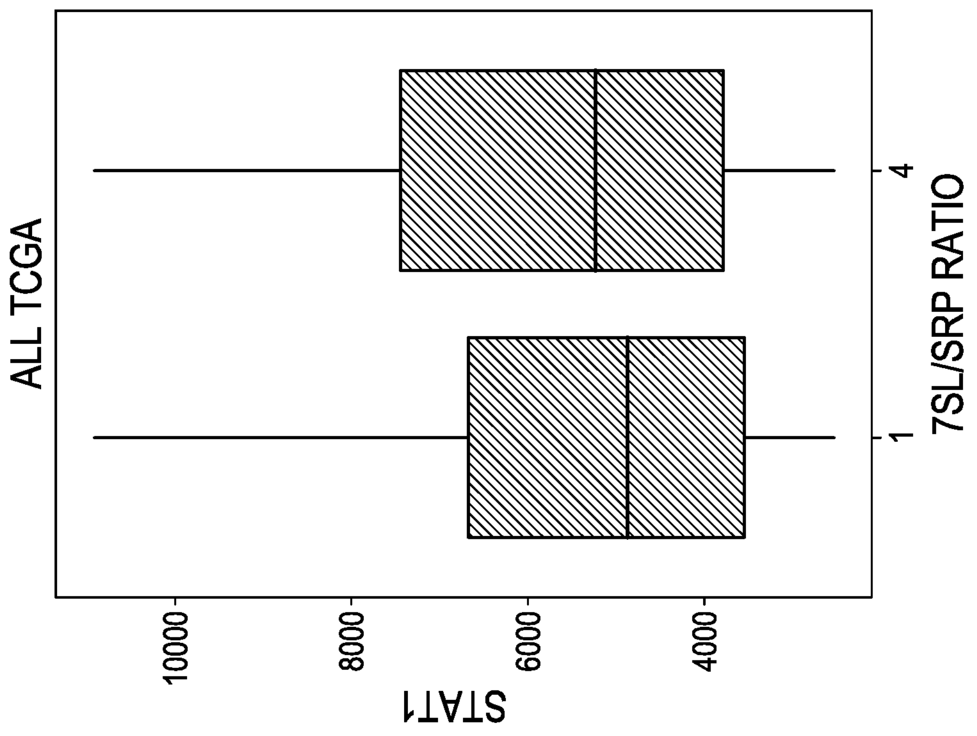

RNA-Seq data from patient samples available in the TCGA data set were assigned to quartiles by level of SRP shielding. This stratification was done by creating a ratio of RN7SL1 reads to SRP9 and SRP14 reads, as these SRP proteins have been experimentally demonstrated to block the immunogenicity of 7SL. Patients were separated into quartiles based on this ratio and then differences in gene expression were assessed between the highest and lowest quartiles (FIGS. 1A, 1B, and 1C). False discovery rate was set by randomly sampling p values obtained by two tailed pairwise T test with multiple comparisons using a Holm correction for 1000 genes and allowing genes with p values below the 10th ranked p value in the random list to be considered differentially regulated. Gene ontology analysis was performed on the top 5 percent of differentially regulated genes using the metascape online interface, enriched terms of interest are listed.

Figure 2A:
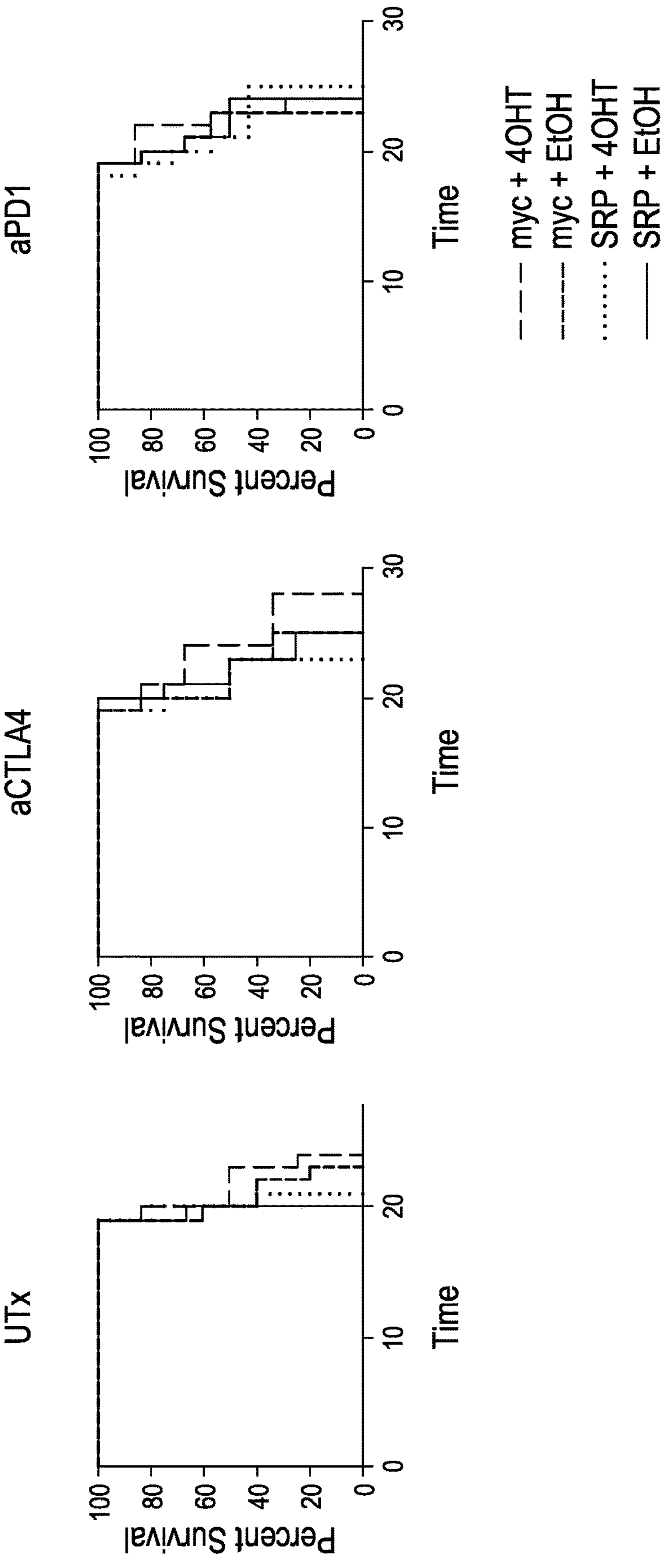
FIGS. 2A and 2B are graphs showing results from a mouse study testing the combination of 7SL with anti-CTLA-4 or anti-PD-1 antibody. Mouse embryonic fibroblasts (MEFs) (referred to as "myc" in FIG. 2A and "ER-myc" in FIG. 2B) or MEFs co-expressing SRP9/14 (referred to as "SRP" in FIG. 2A and "ER-myc SRP" in FIG. 2B) were treated with 4OHT or EtOH. EtOH treatment and SRP overexpression were used as negative controls. WT C57BL/6 mice were injected with mixed tumors consisting of B16-F10 tumor cells and MEFs treated as indicated s.c. in the flank.
Figure 2B:
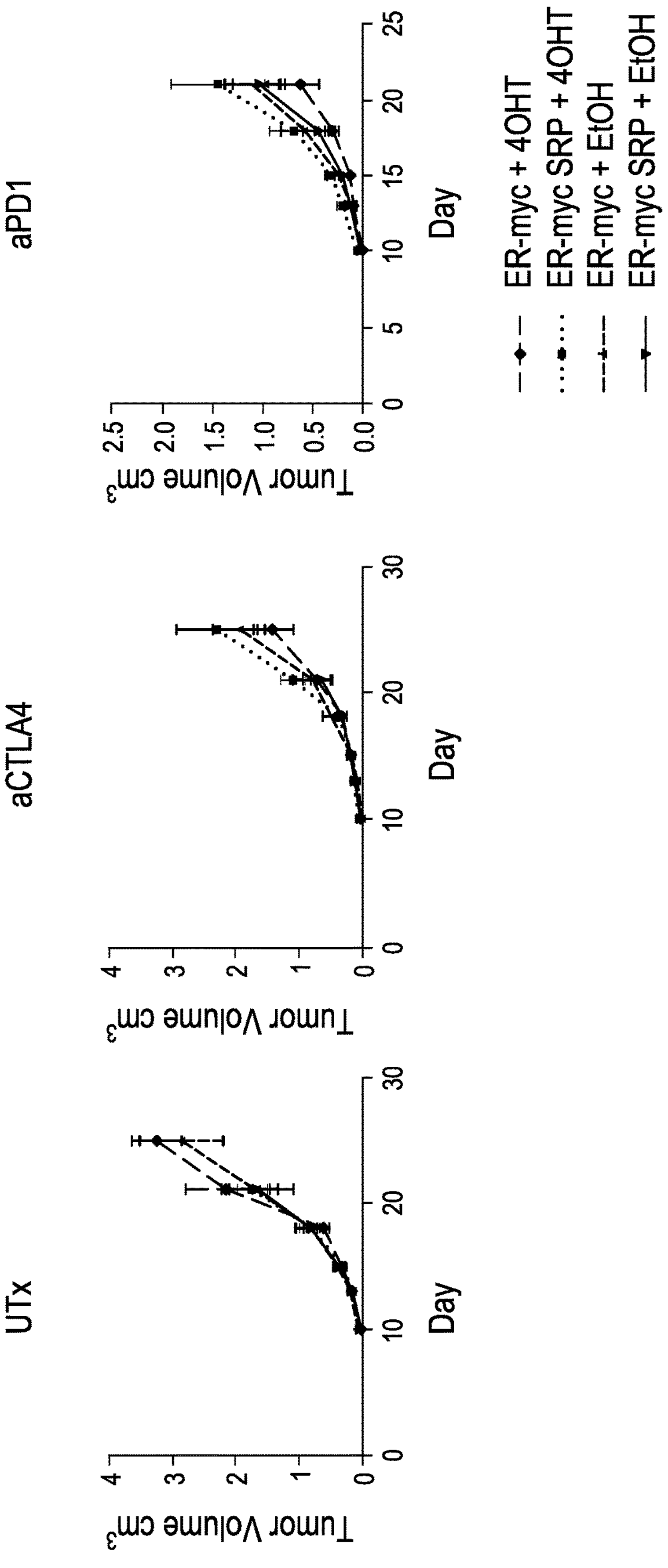

Unshielded 7SL does not Significantly Impact Response to Inhibitory Checkpoint Blockade Therapy Wild type (WT) C57BL/6 mice were injected with $5\times10^4$ B16-F10 tumor cells subcutaneously in the flank with $5\times10^4$ MYC activated mouse embryonic fibroblasts (MEFs) or MYC activated MEFs co-expressing SRP9/14. MYC activation is inducible with 4-OHT and results in the secretion of exosomes containing unshielded 7SL1 RNA, while co-expression of SRP9/14 ensures the 7SL1 RNA remains relatively shielded, allowing measurement of the stimulatory capacity specifically of the unshielded form (Nabet B Y, et al. Cell. 2017; 170(2):352-366.e13). Mice were subsequently treated with the anti-CTLA-4 or anti-PD-1 antibody (or not), and then tumor growth was monitored by caliper. Endpoint criterion was considered a tumor measurement of 1.5 cm in any direction. As shown in FIGS. 2A and 2B, unshielded 7SL does not significantly impact response to anti-CTLA-4 or anti-PD-1 therapy.

Unshielded 7SL Drives Myeloid Infiltration into the Tumor Microenvironment

Figure 3A:
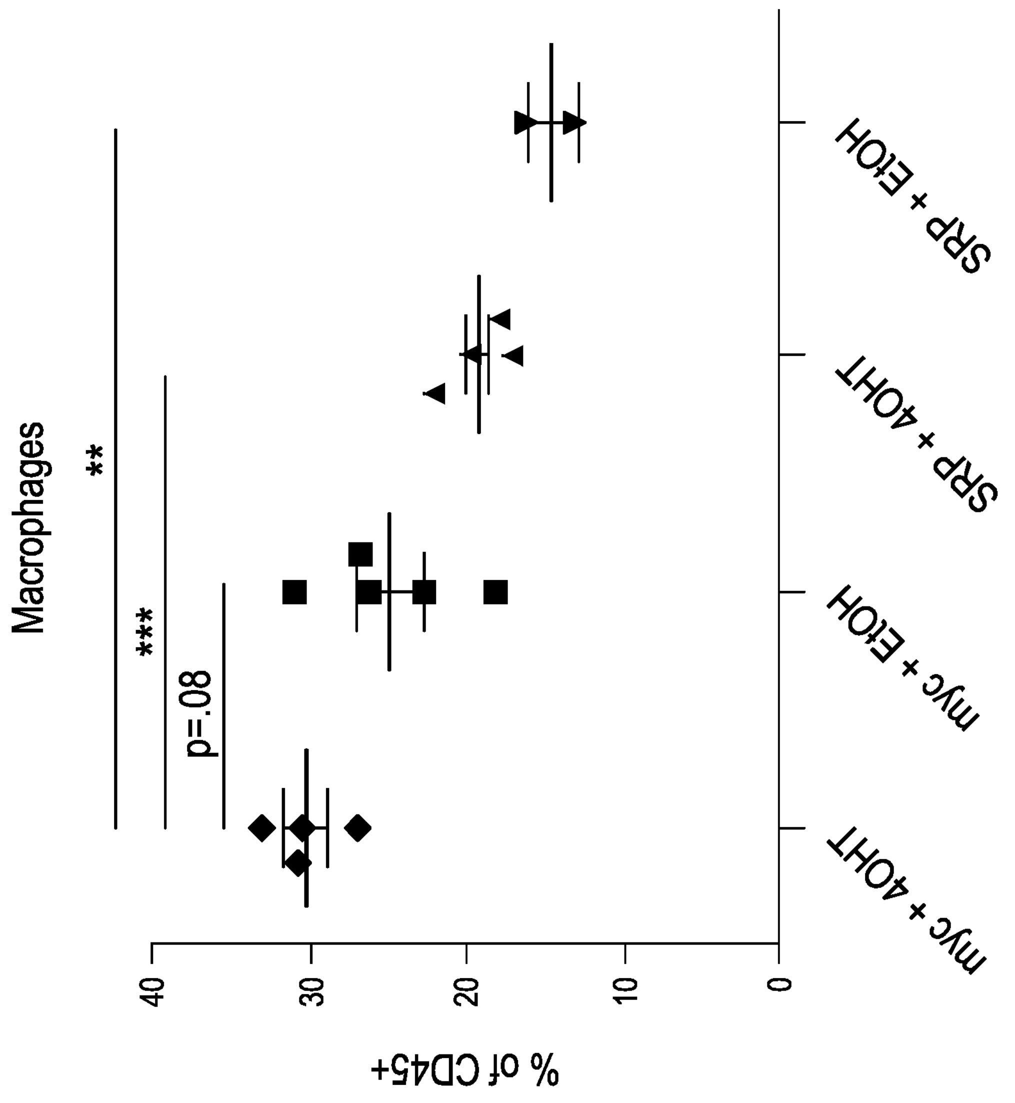
FIGS. 3A, 3B, 3C, 3D, 3E, and 3F are graphs showing results from mouse studies testing the impact of 7SL on macrophage recruitment and polarization. MEFs (referred to as "myc" in FIGS. 3A and 3B) or MEFs co-expressing SRP9/14 (referred to as "SRP" in FIGS. 3A and 3B) were treated with 4OHT or EtOH. EtOH treatment and SRP overexpression were used as negative controls.
Figure 3B:
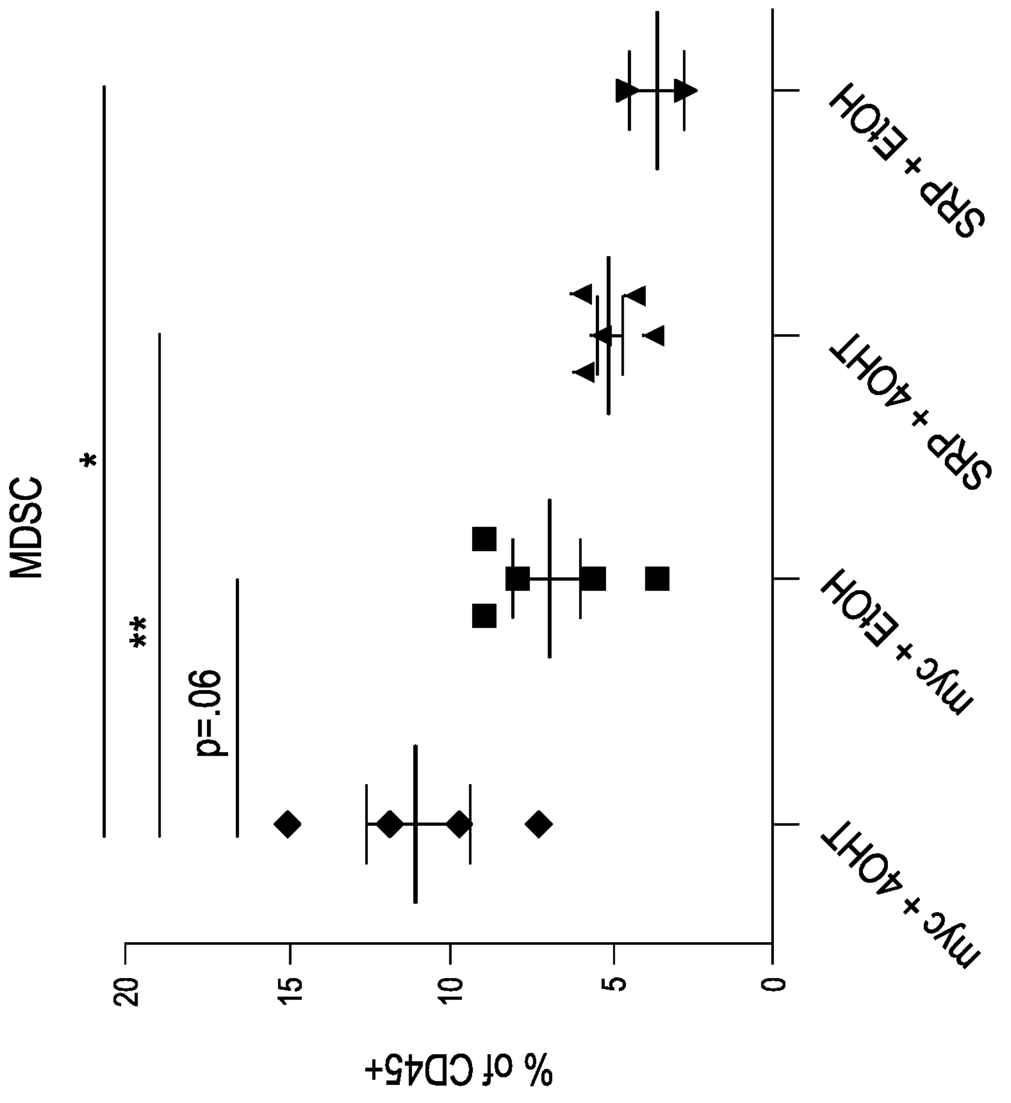
Figure 3C:
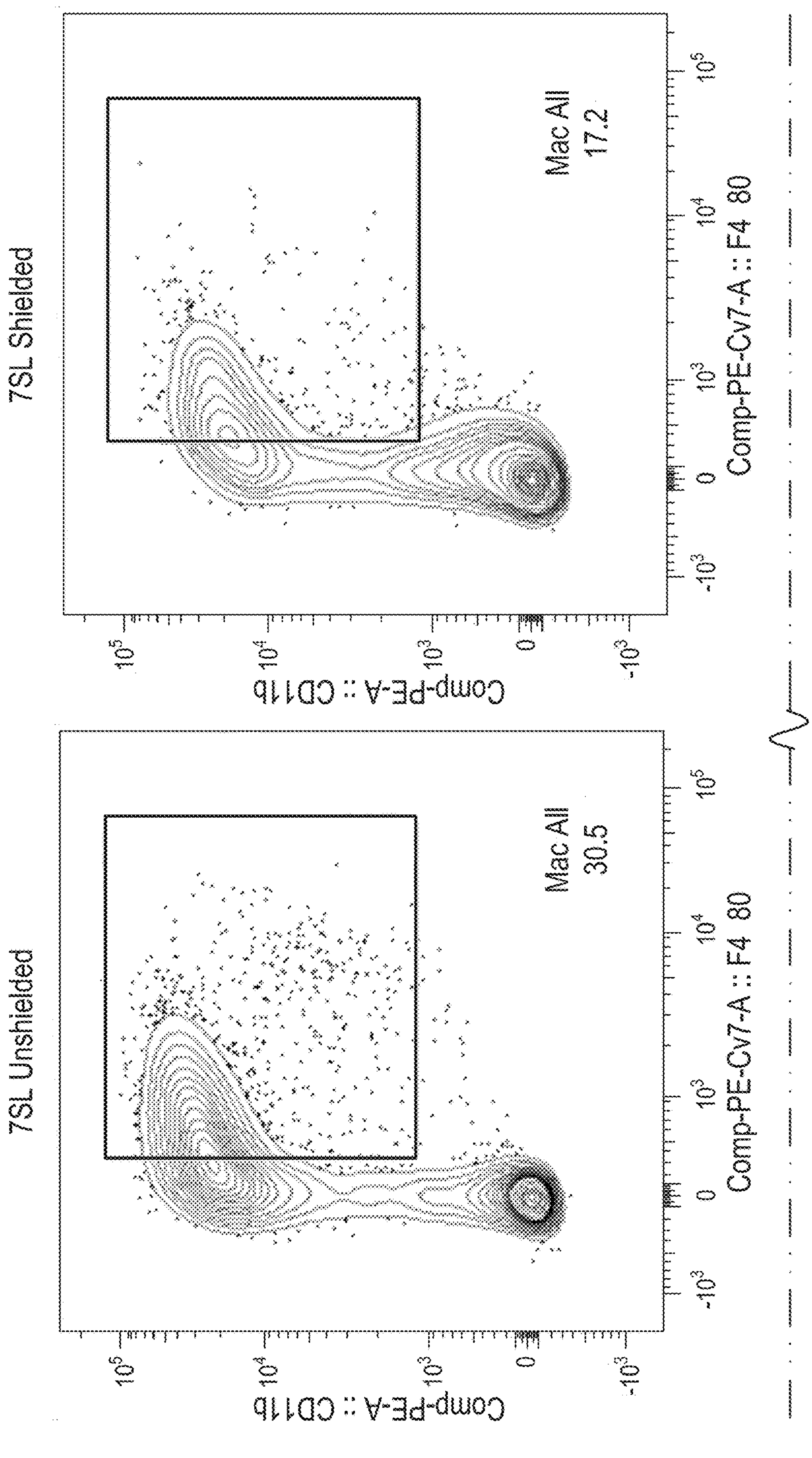
Figure 3C:
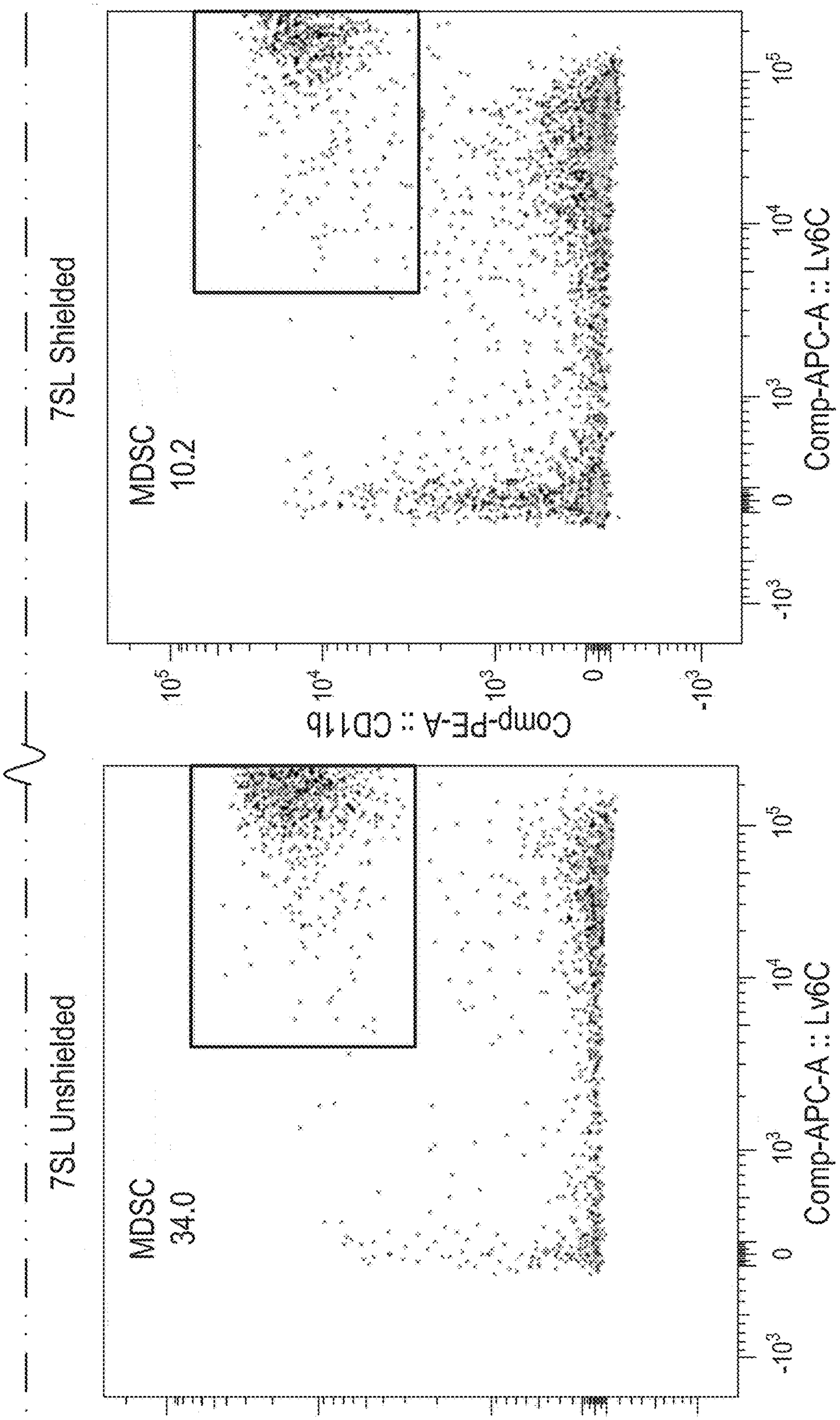
Figure 3D:
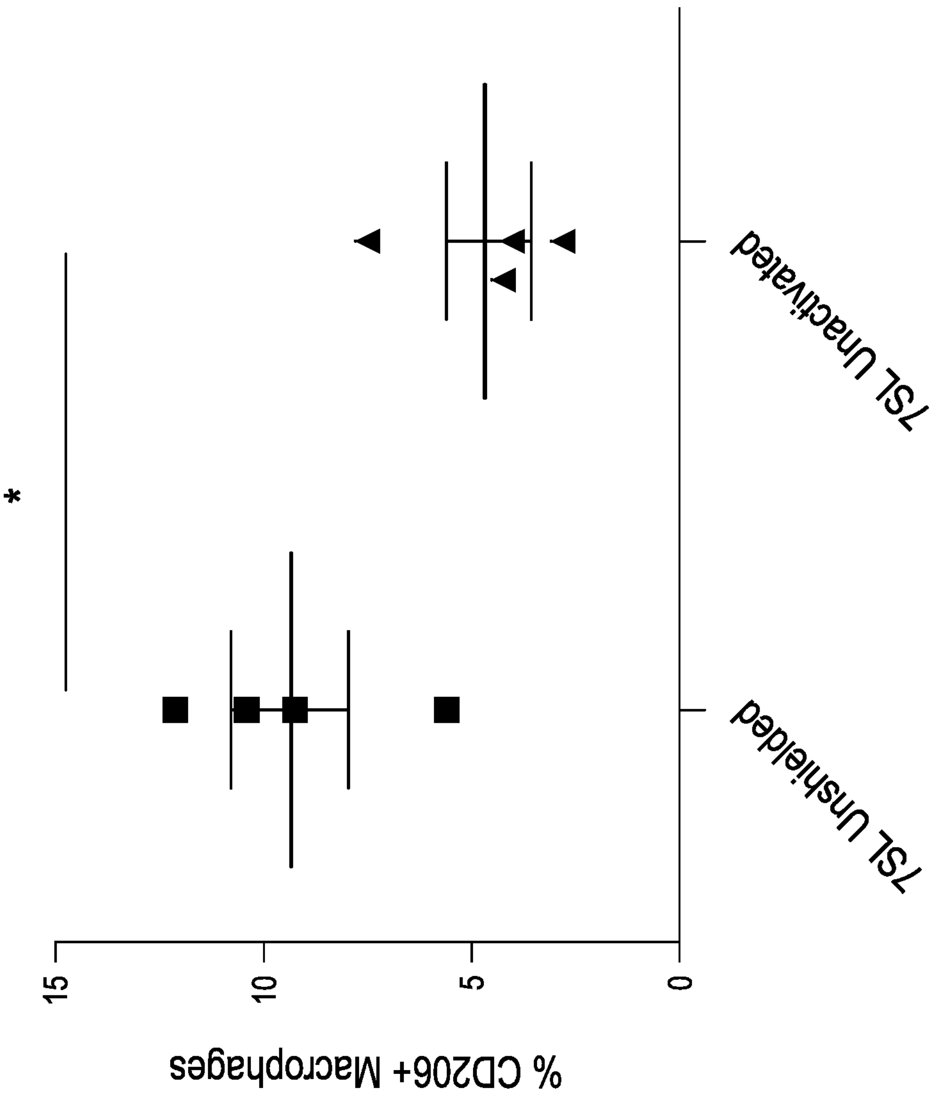

For the study shown in FIGS. 3A-3C, mice were implanted with tumors as described in the study shown in FIGS. 2A and 2B. Tumors were harvested 13 days later and assessed for infiltration of macrophages or myeloid derived suppressor cells (MDSCs). Macrophages are considered Lin−, F4/80+, and CD11b+ cells. MDSCs are considered Lin−, F4/80−, CD11c−, CD11b+, and Ly6C+ cells. For the study shown in FIG. 3D, tumors were treated with anti-CTLA4 blocking antibody as described in the study shown in FIGS. 2A and 2B, and tumors were harvested at d15 to measure M2 polarization of macrophages as marked by CD206. As shown in FIGS. 3A-3D, unshielded 7SL may drive myeloid infiltration into the tumor microenvironment.

Figure 3E:
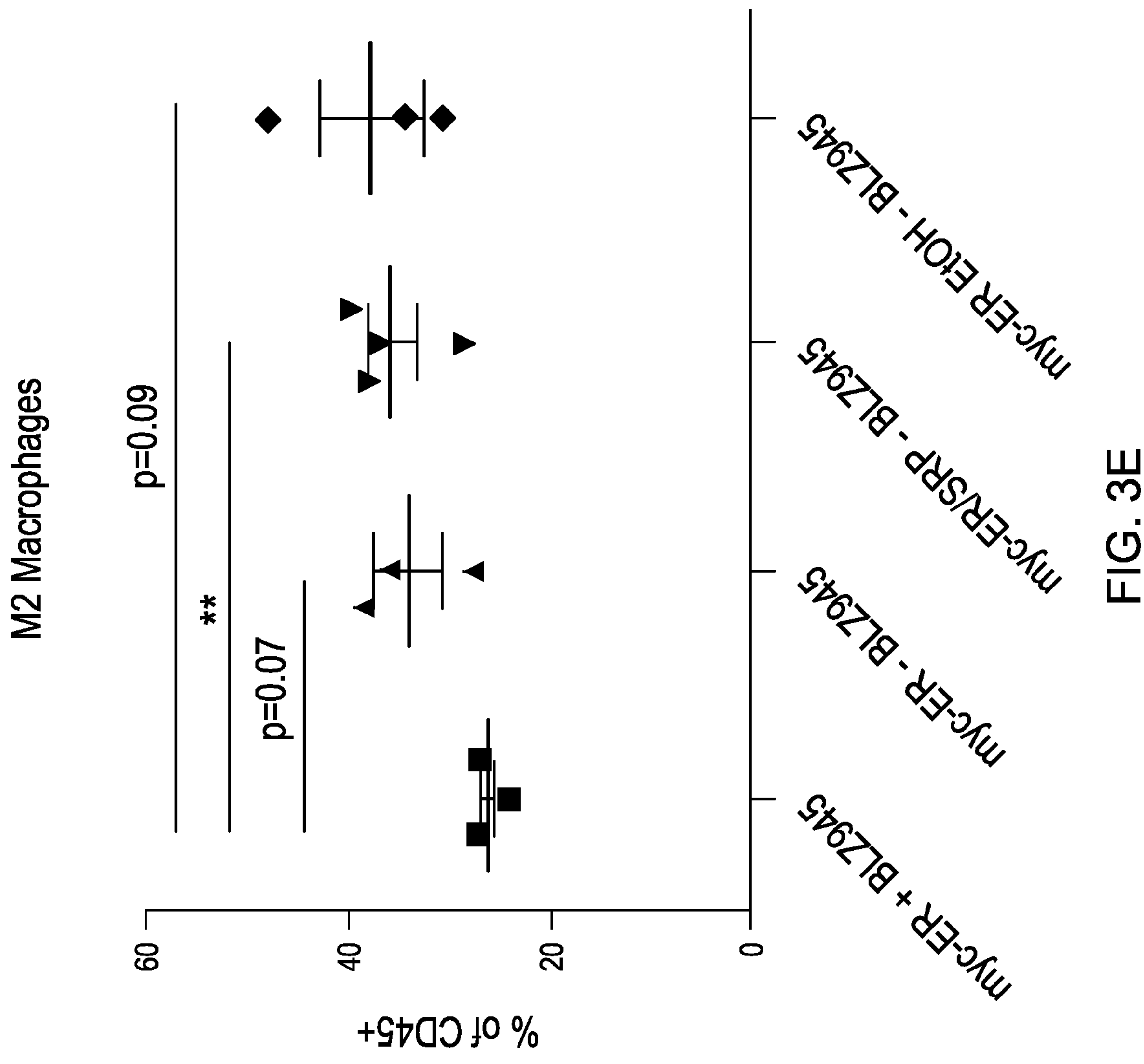
Figure 3F:
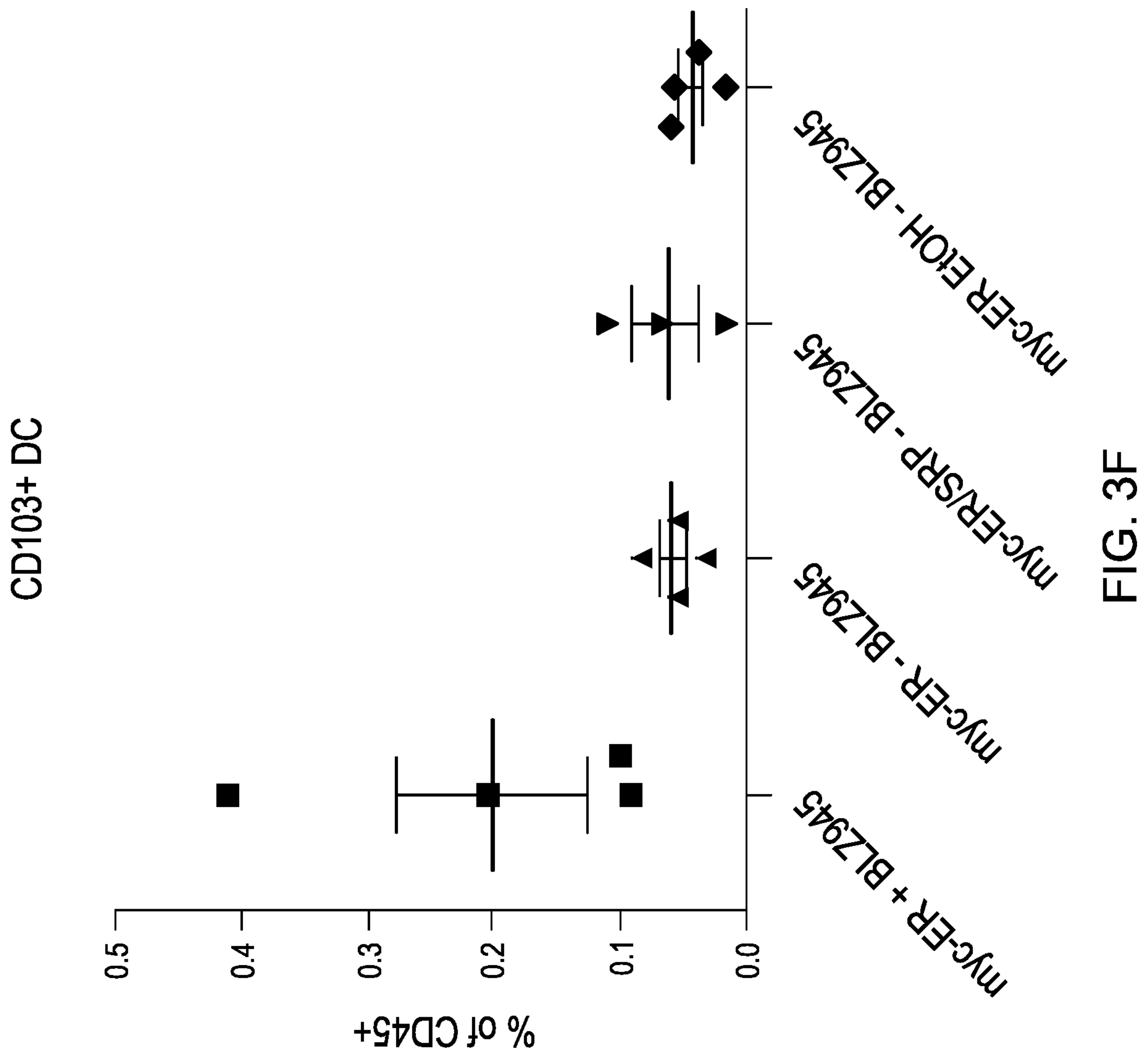

Furthermore, mice were implanted with the same tumors and subsequently treated with the CSF1R inhibitor BLZ945. Polarization of macrophages and frequency of CD103+ DCs were tested. Inhibition of CSF1R signaling in the presence of high levels of unshielded 7SL RNA decreased the frequency of M2 macrophages found in the tumor (FIG. 3E) while improving the infiltration of cross-presenting CD103+ DCs (FIG. 3F).

Inhibition of M2 Polarization Allows Tumors with High Levels of Unshielded 7SL to Respond More Robustly to Checkpoint Blockade Tumors were implanted as in the study shown in FIGS. 2A and 2B and treated with CSF1R inhibitor BLZ945 (Novartis) every 2 days for 2 weeks starting at day 0 to prevent M2 polarization of infiltrating myeloid cells. Mice were additionally treated with anti-CTLA4 (FIG. 4A) or anti-CTLA4 and anti-PD1 (FIGS. 4B, 4C, 4D, and 4E) on days 5, 8, and 11. Tumor growth was monitored by caliper. As shown in FIGS. 4A-4E, treatment with CSF1R inhibitor BLZ945 allows tumors with high levels of unshielded 7SL to respond more robustly to checkpoint blockade.

Figure 4A:
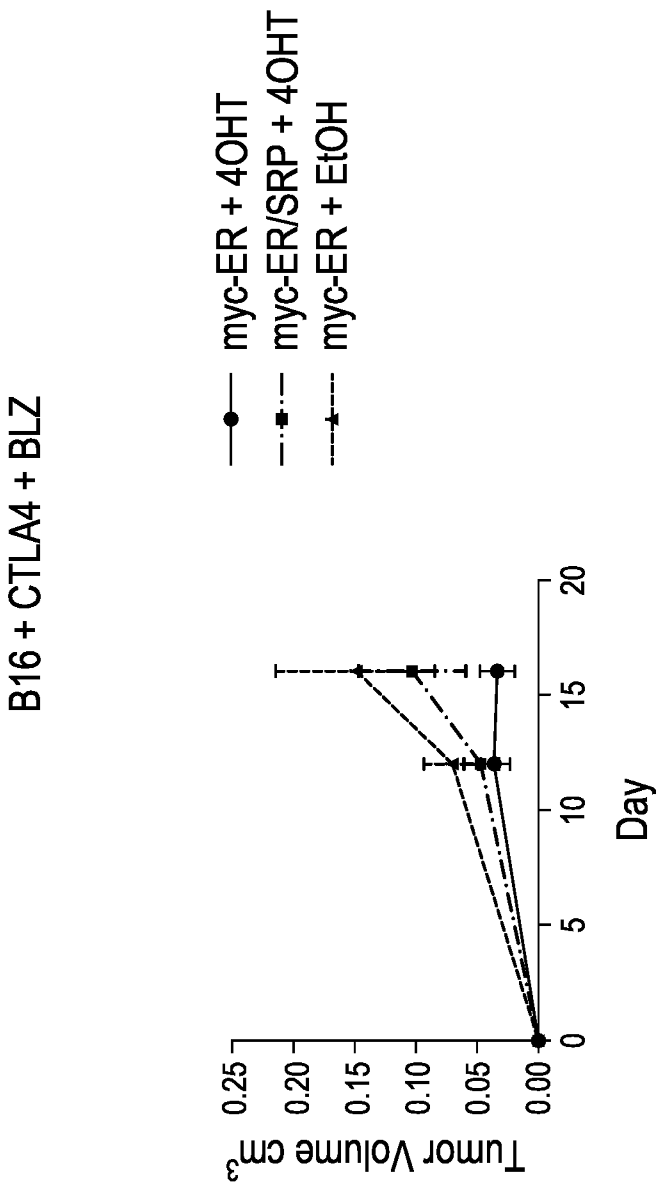
FIGS. 4A, 4B, 4C, 4D, 4E, and 4F are graphs showing results from mouse studies testing the combination of 7SL, anti-CTLA-4 and/or anti-PD-1 antibody, and CSF1R inhibitor BLZ945.
Figure 4B:
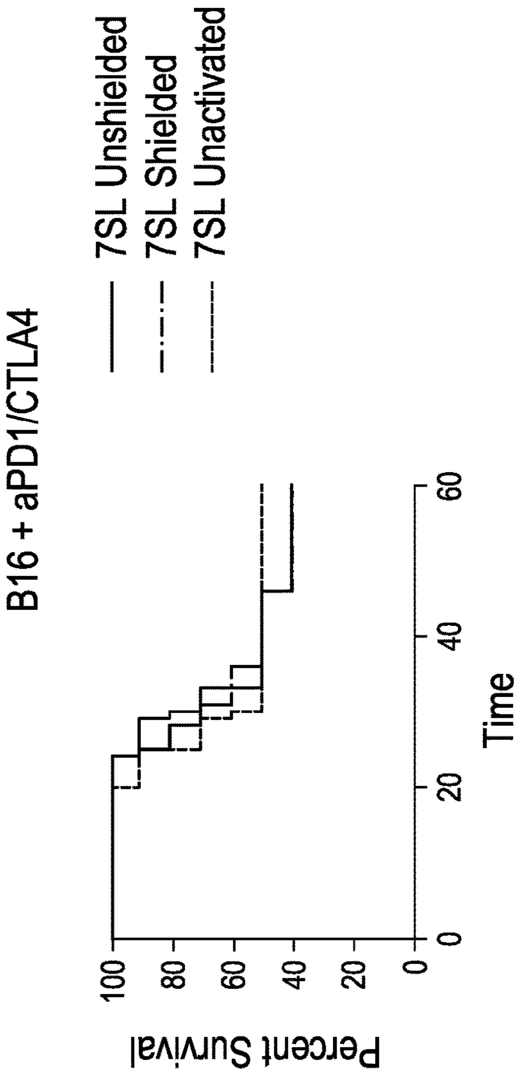
Figure 4C:
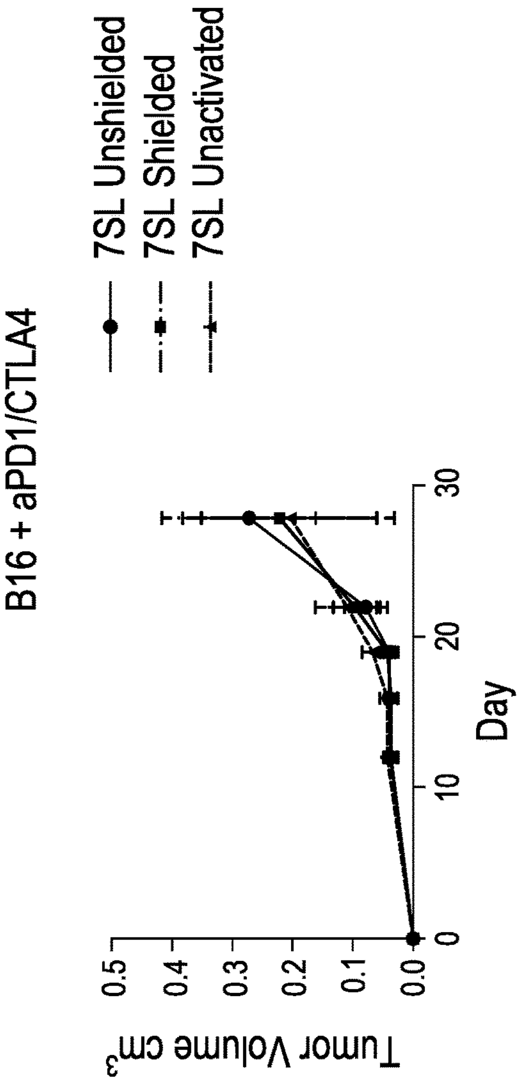
Figure 4D:
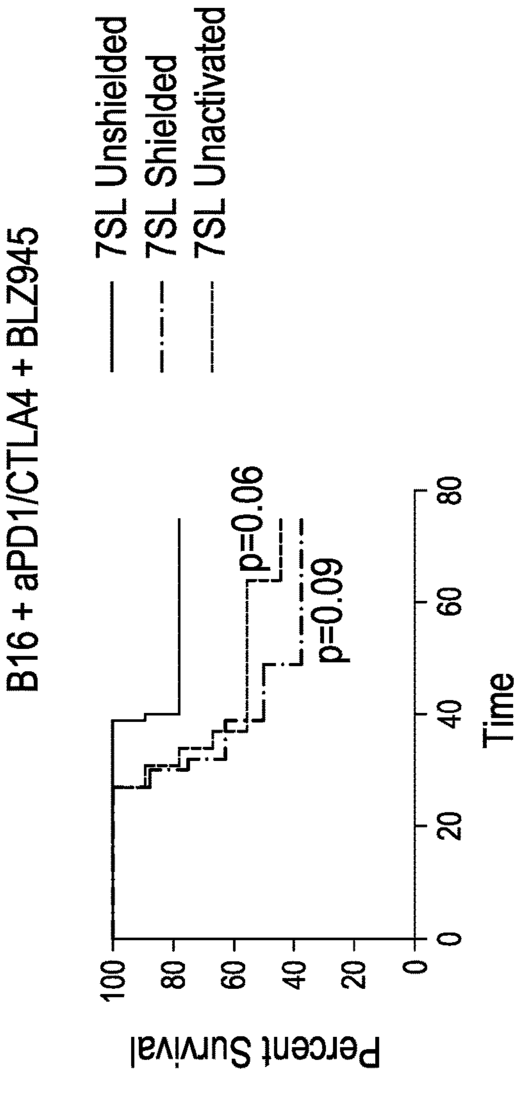
Figure 4E:
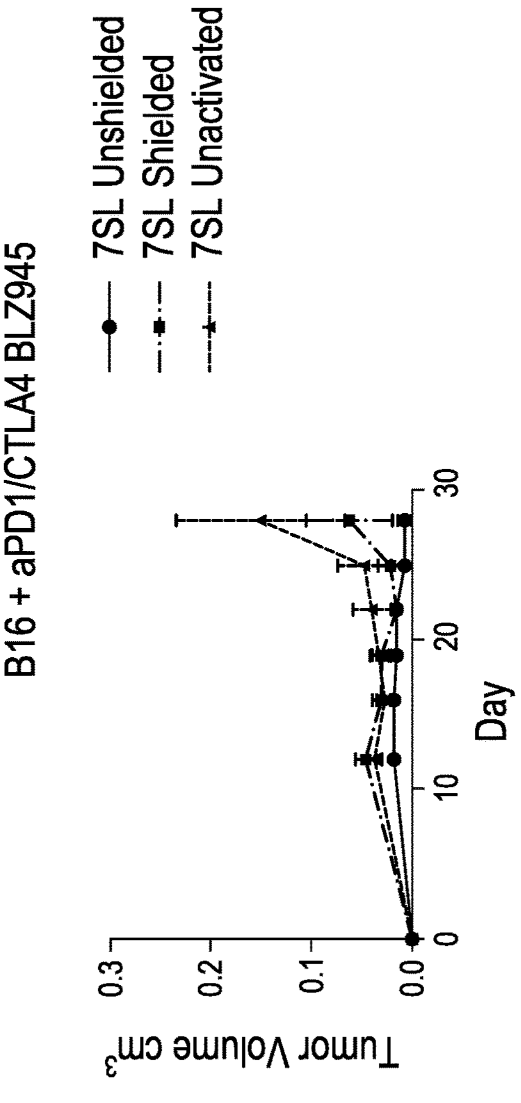
Figure 4F:
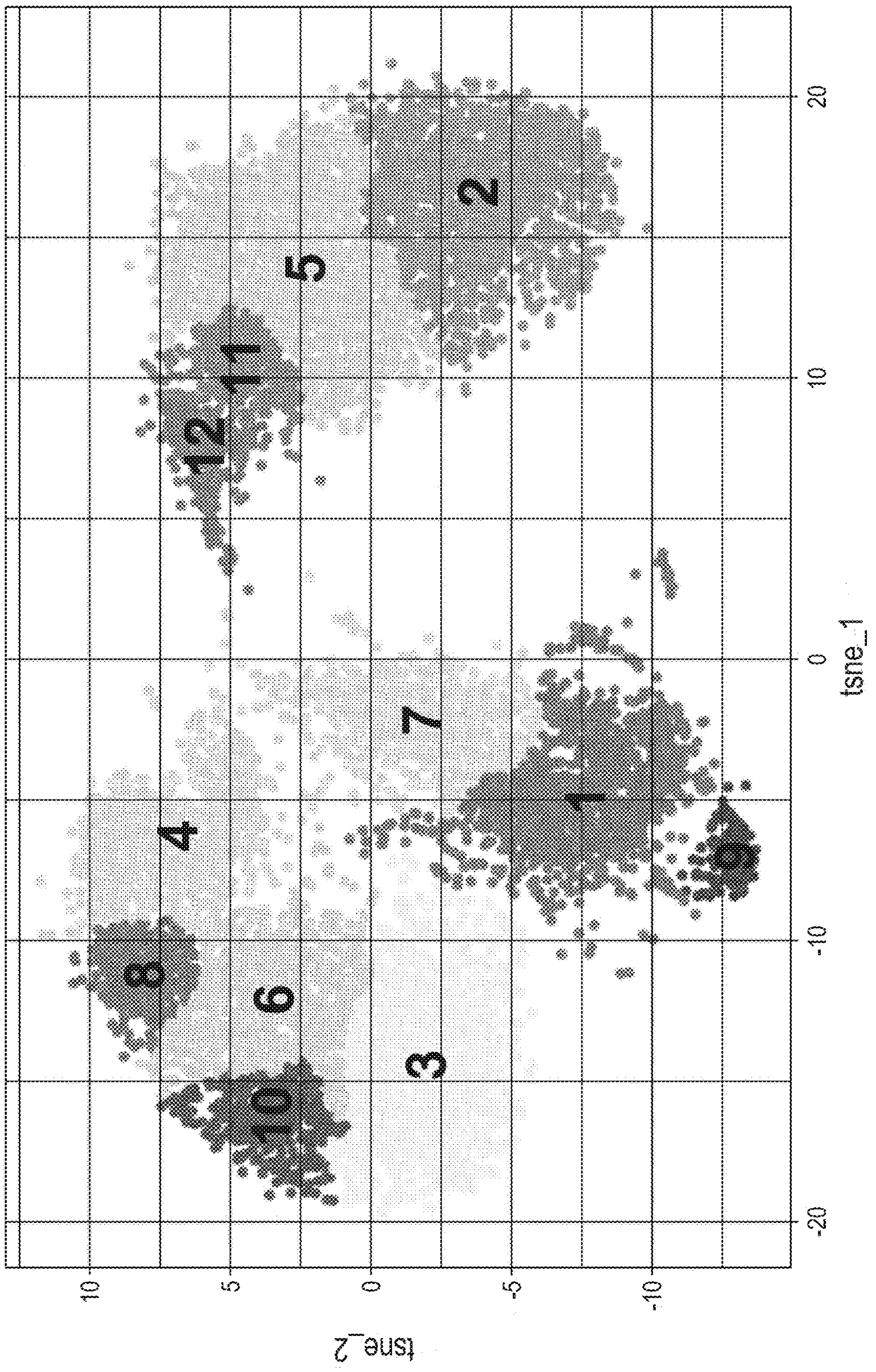
Figure 4F:
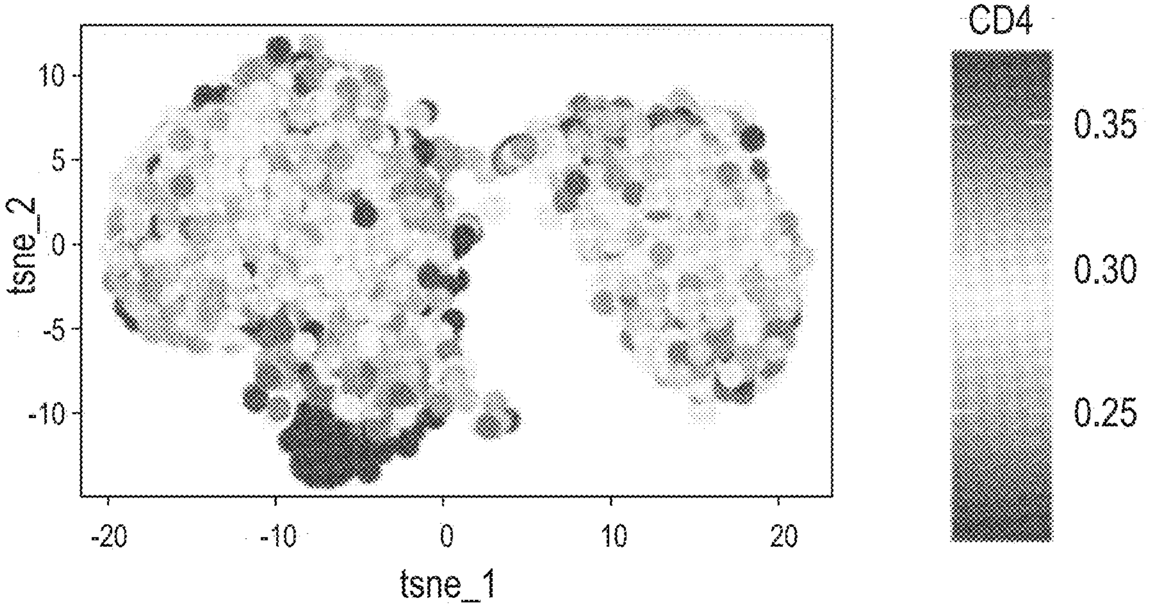
Figure 4F:
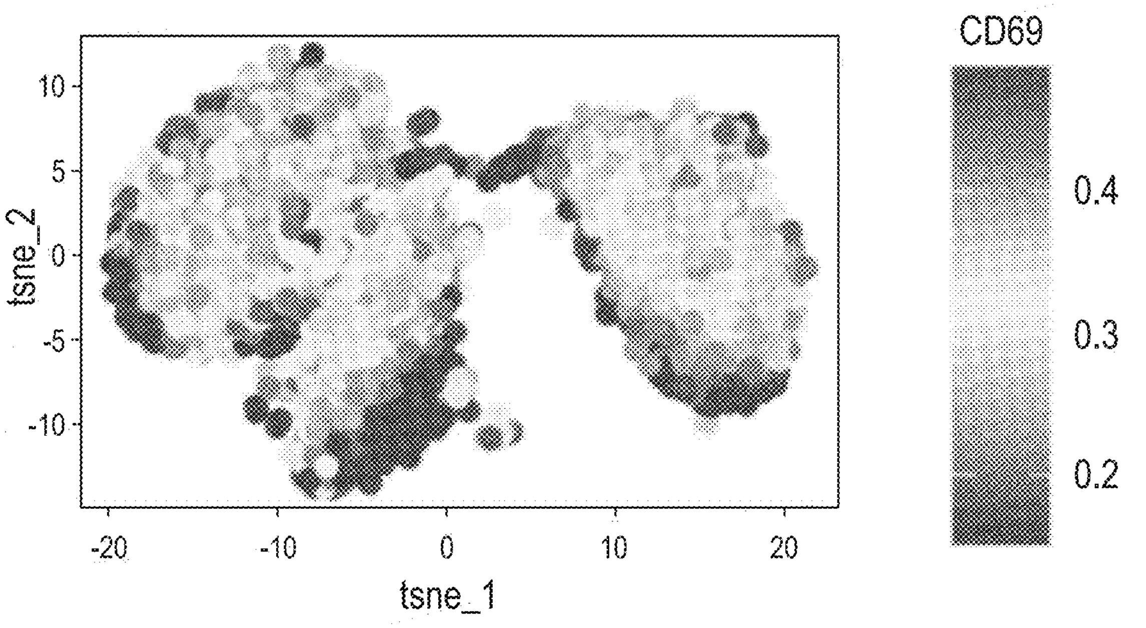
Figure 4F:
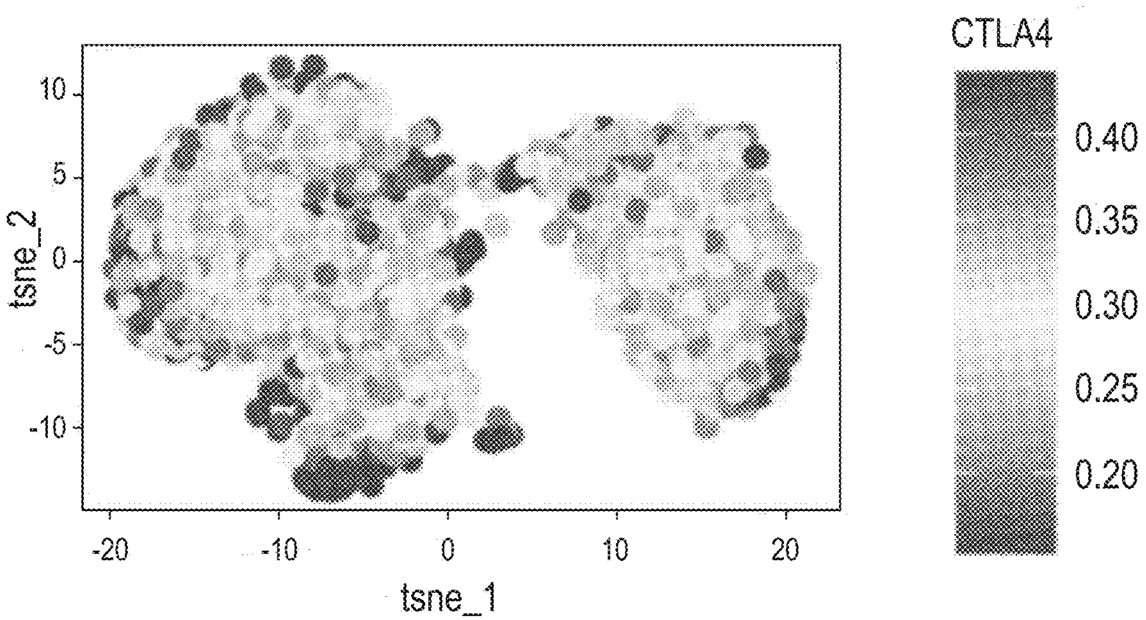
Figure 4F:
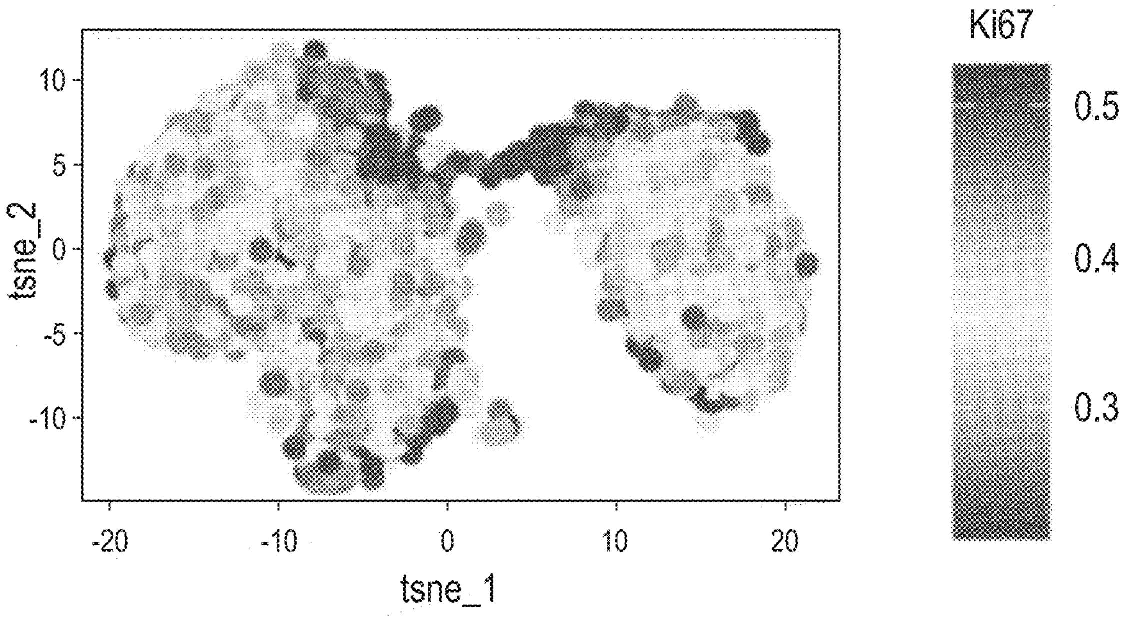
Figure 4F:
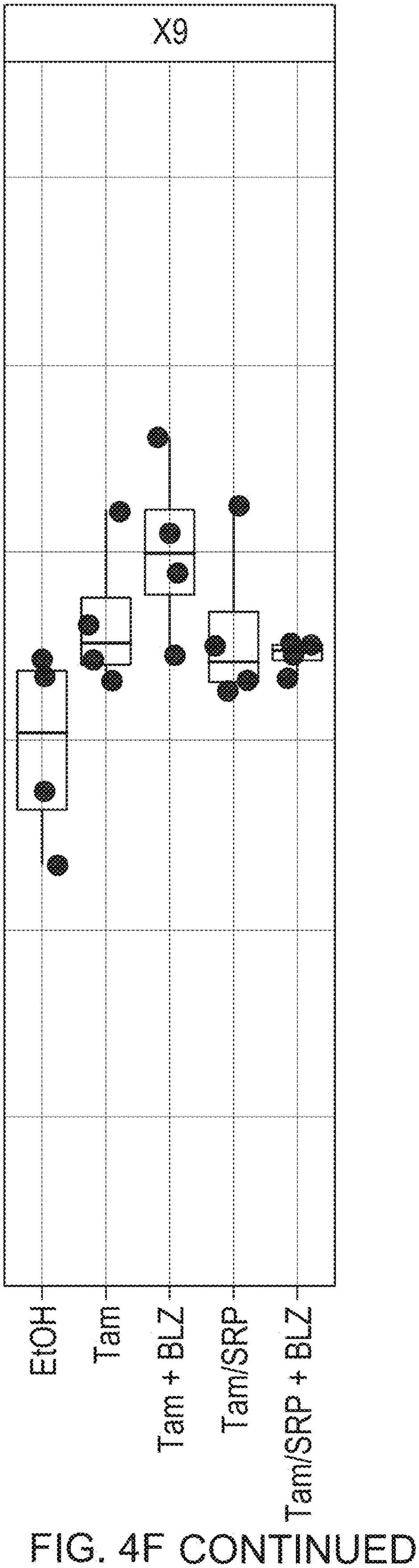

In addition, mice were implanted with tumors and treated with anti-CTLA4+/−CSF1Ri BLZ945. Tumors were harvested 13 days later and immune populations were assessed using an unbiased clustering of flow cytometry data. Activated CD4+ T cells stood out as markedly increased in tumors with high levels of unshielded 7SL that were also treated with CSF1Ri, indicating that CSF1R-driven myeloid polarization prevents optimal CD4+ T cell activation and polarization, and that this activation is important to response to ICB (FIG. 4F).

Figure 5A:
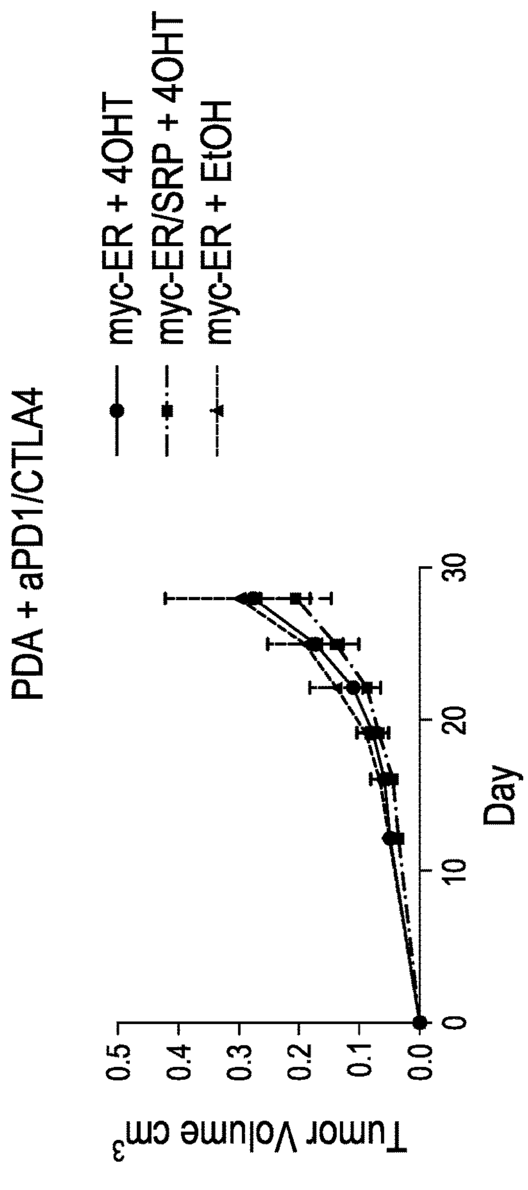
FIGS. 5A and 5B are graphs showing results from a study testing the combination of 7SL, anti-CTLA-4 antibody, anti-PD-1 antibody, and CSF1R inhibitor BLZ945 in a pancreatic ductal adenocarcinoma (PDA) mouse model.
Figure 5B:
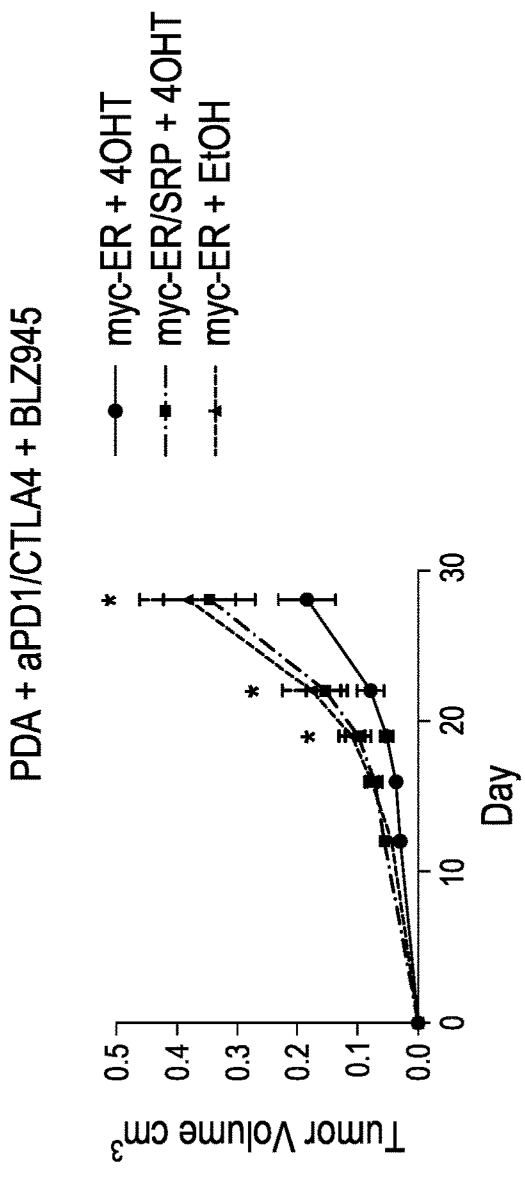

CSF1R Inhibition in Combination with Unshielded 7SL RNA Sensitizes PDA Tumors to ICB Therapy $1\times10^5$ pancreatic ductal adenocarcinoma (PDA) tumor cells were co-injected with $1\times10^5$ MEFs ("myc-ER") or MEFs co-expressing SRP9/14 ("myc-ER/SRP") treated with 4OHT or EtOH. Mice were then treated with a combination of anti-CTLA4 and anti-PD1 antibodies (FIG. 5A) or a triple combination of anti-CTLA4, anti-PD1, and BLZ945 (FIG. 5B) using treatment schedules outlined in the study shown in FIGS. 4A-4C. Tumor growth was monitored by caliper. As shown in FIG. 5B, CSF1R inhibitor BLZ945 in combination with unshielded 7SL RNA sensitizes PDA tumors to anti-PD-1 and anti-CTLA-4 antibody therapies.

Figure 6A:
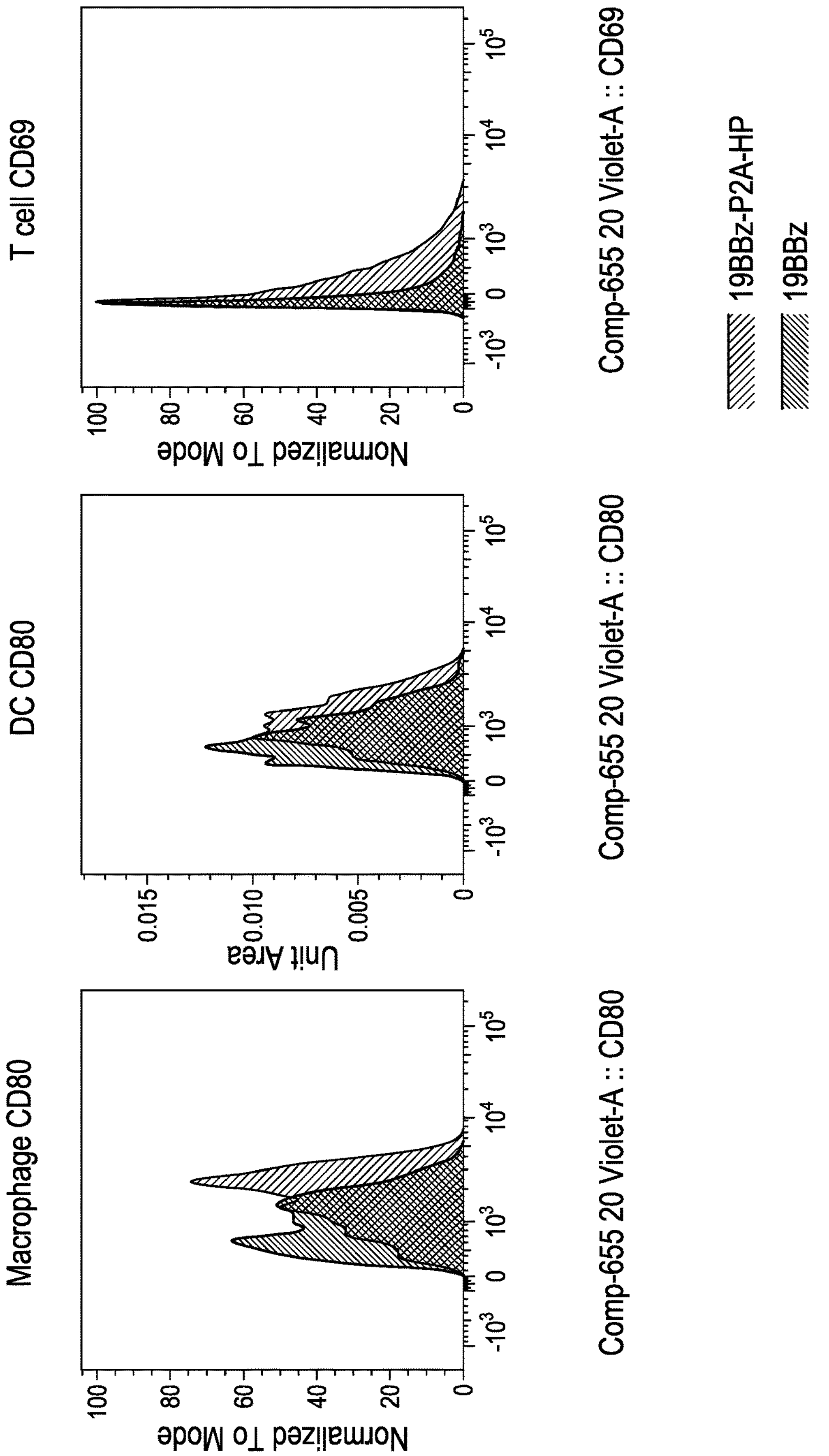
FIGS. 6A and 6B are graphs showing results from an in vitro study testing murine h19BBz-P2A-HP (Hairpin) CAR T cells. Transduced murine T cells were placed in culture with naïve murine splenocytes for 24 hrs.
Figure 6B:
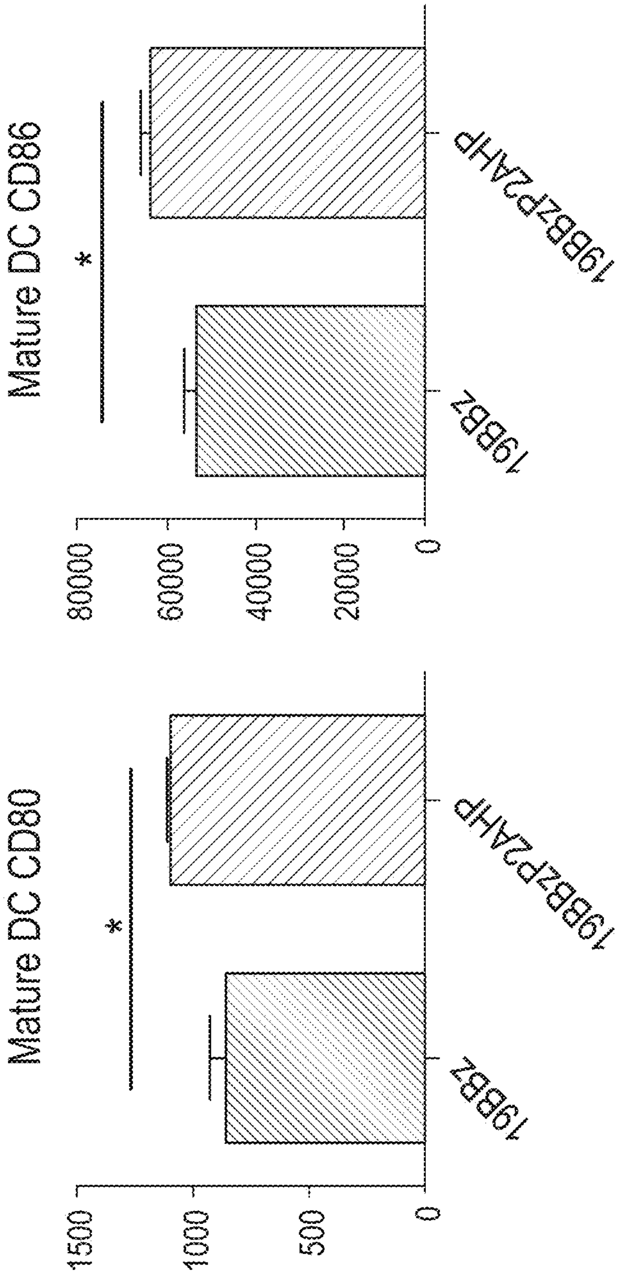
Figure 6B:
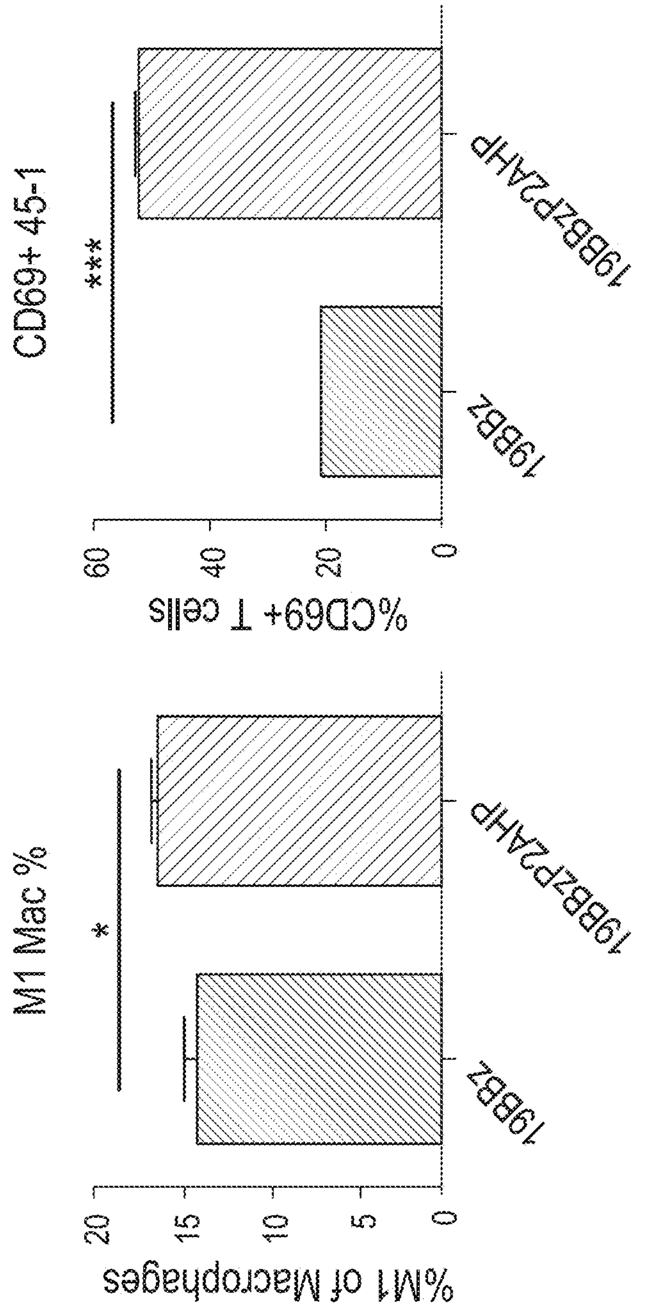

Murine h19BBz-P2A-HP (Hairpin) CAR T Cells Stimulate Bystander Antigen Presenting Cell Populations Murine T cells were transduced with h19BBz or h19BBz-P2A-HP CAR constructs following anti-CD3/CD28 bead simulation. h19BBz is a CAR construct comprising an anti-CD19 scFv connected to a hinge domain, a transmembrane domain, and intracellular portions of 4-1BB and CD3ζ. h19BBz, also called CTL019, comprises the amino acid sequence of SEQ ID NO: 26. HP represents a perfectly matched synthetic hairpin RNA with length of 25 bp in order to mimic the immunogenic activity of 7SL while avoiding potential shielding via recognition of homologous sequences by shielding proteins. The HP RNA comprises the nucleotide sequence of SEQ ID NO: 10. The DNA sequence encoding the HP RNA comprises the nucleotide sequence of SEQ ID NO: 9. The h19BBz-P2A-HP CAR construct encodes, from N- to C-orientation, the hairpin RNA, P2A, and h19BBz. The h19BBz-P2A-HP CAR construct comprises the nucleotide sequence of SEQ ID NO: 22. Following 3 days of expansion, $2\times10^6$ CD45.1 T cells were placed in culture with $2\times10^6$ CD45.2 naïve splenocytes. 24 hours later cells were analyzed by flow cytometry. Mature DCs and M1 macrophages were identified by assessing expression of CD80. T cell activation was assessed by measuring expression of CD69. As shown in FIGS. 6A and 6B, murine h19BBz-P2A-HP CAR T cells led to a higher level of activation of macrophages, DCs and bystander T cells than murine h19BBz CAR T cells did.

Figure 7A:
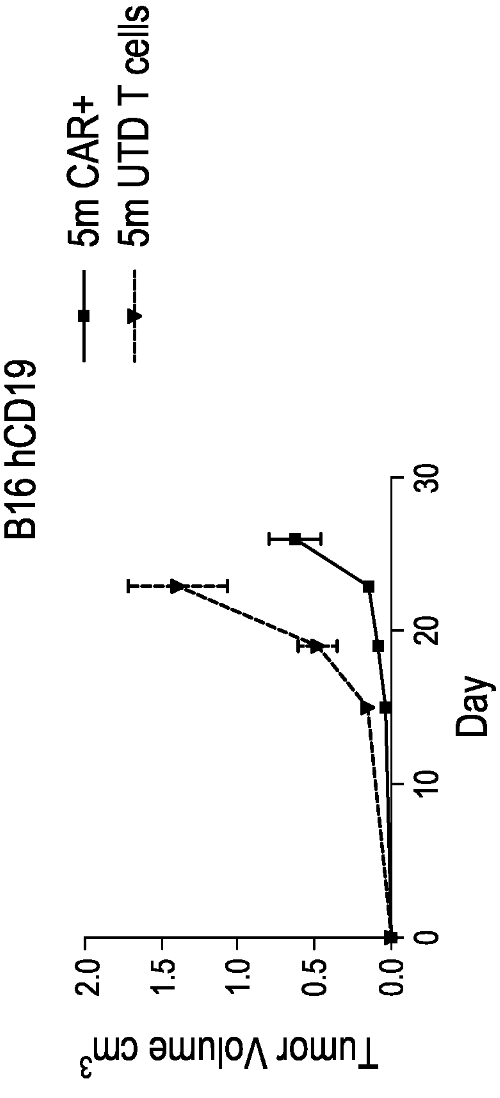
FIGS. 7A, 7B, 7C, 7D, 7E, and 7F are graphs showing results from mouse studies testing murine h19BBz CAR T cells and murine h19BBz-P2A-HP (Hairpin) CAR T cells.
Figure 7B:
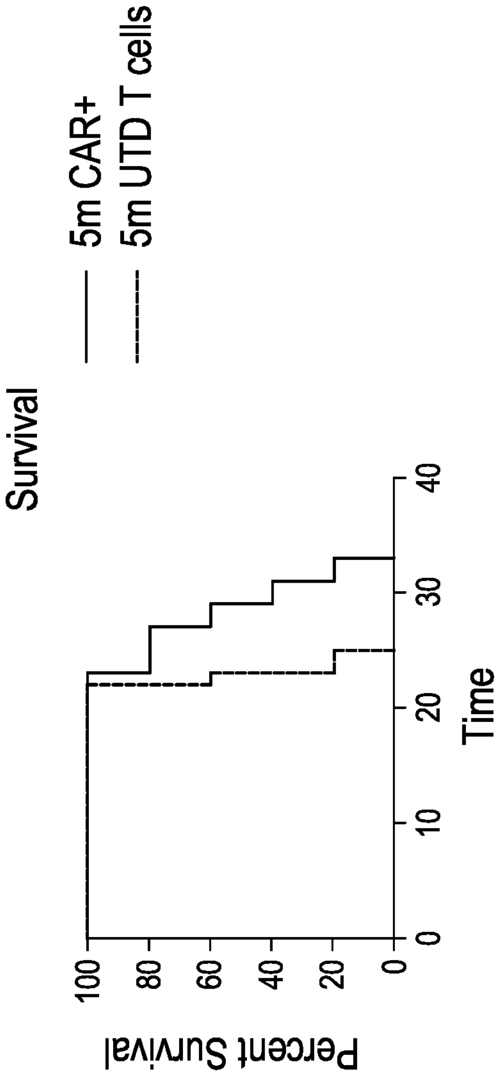

Murine h19BBz-P2A-HP CAR T Cells Show Improved Efficacy as Compared to Murine h19BBz CAR T Cells Mice were implanted with B16-hCD19 tumors and treated with murine CAR T cells bearing the h19BBz construct. Tumor growth and survival were tested (FIGS. 7A and 7B).

Figure 7C:
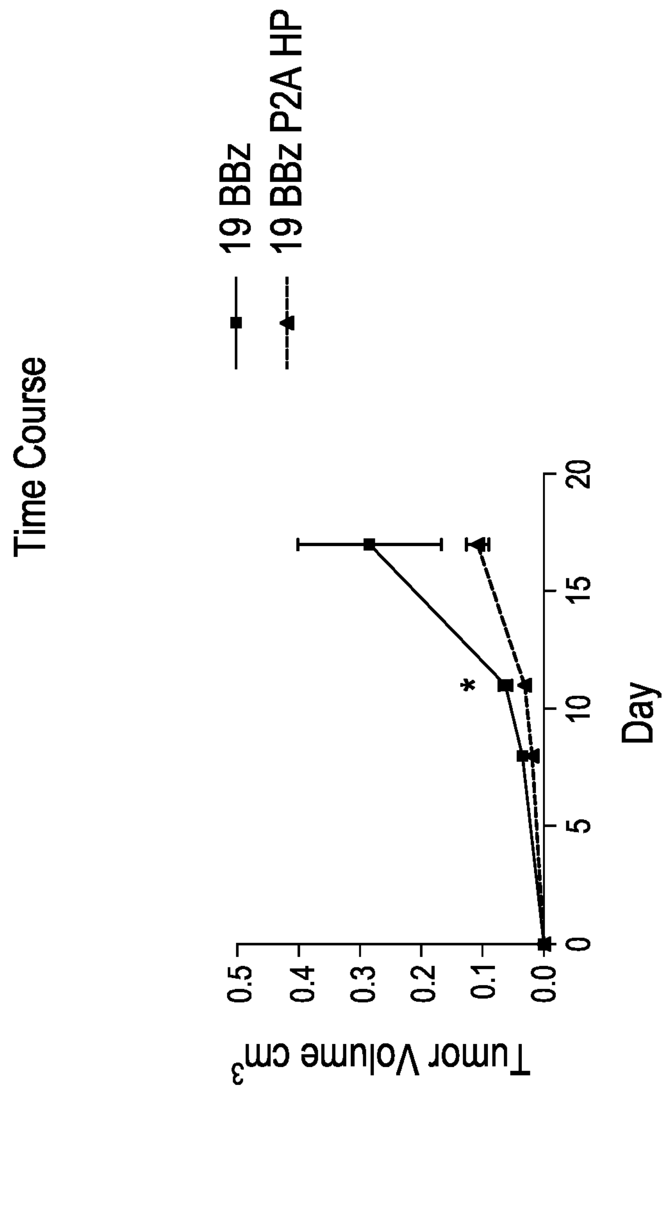

In a second study, mice were implanted with the same tumors and treated with murine h19BBz CAR T cells or murine h19BBz-P2A-HP CAR T cells. As shown in FIG. 7C, murine h19BBz-P2A-HP CAR T cells showed better anti-tumor activity than murine h19BBz CAR T cells.

Figure 7D:
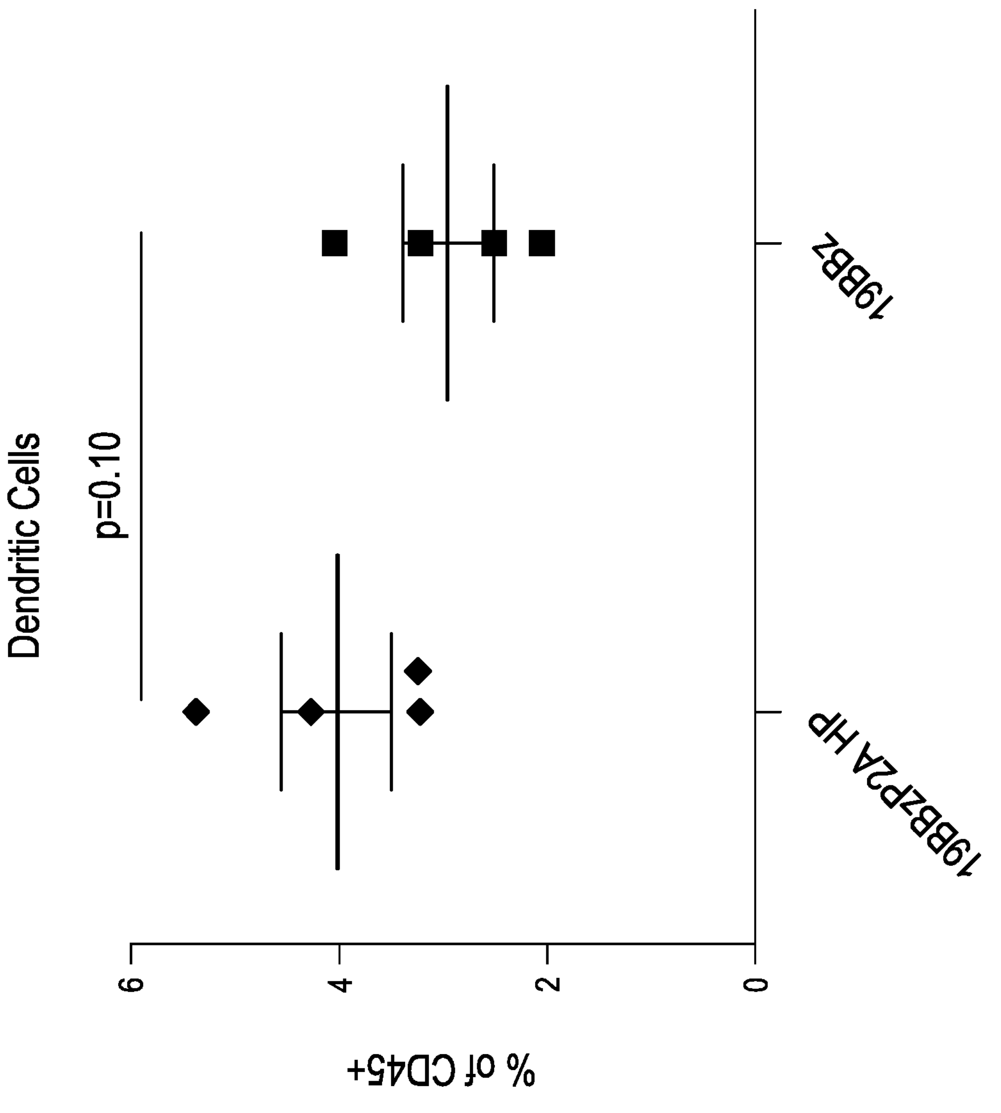
Figure 7E:
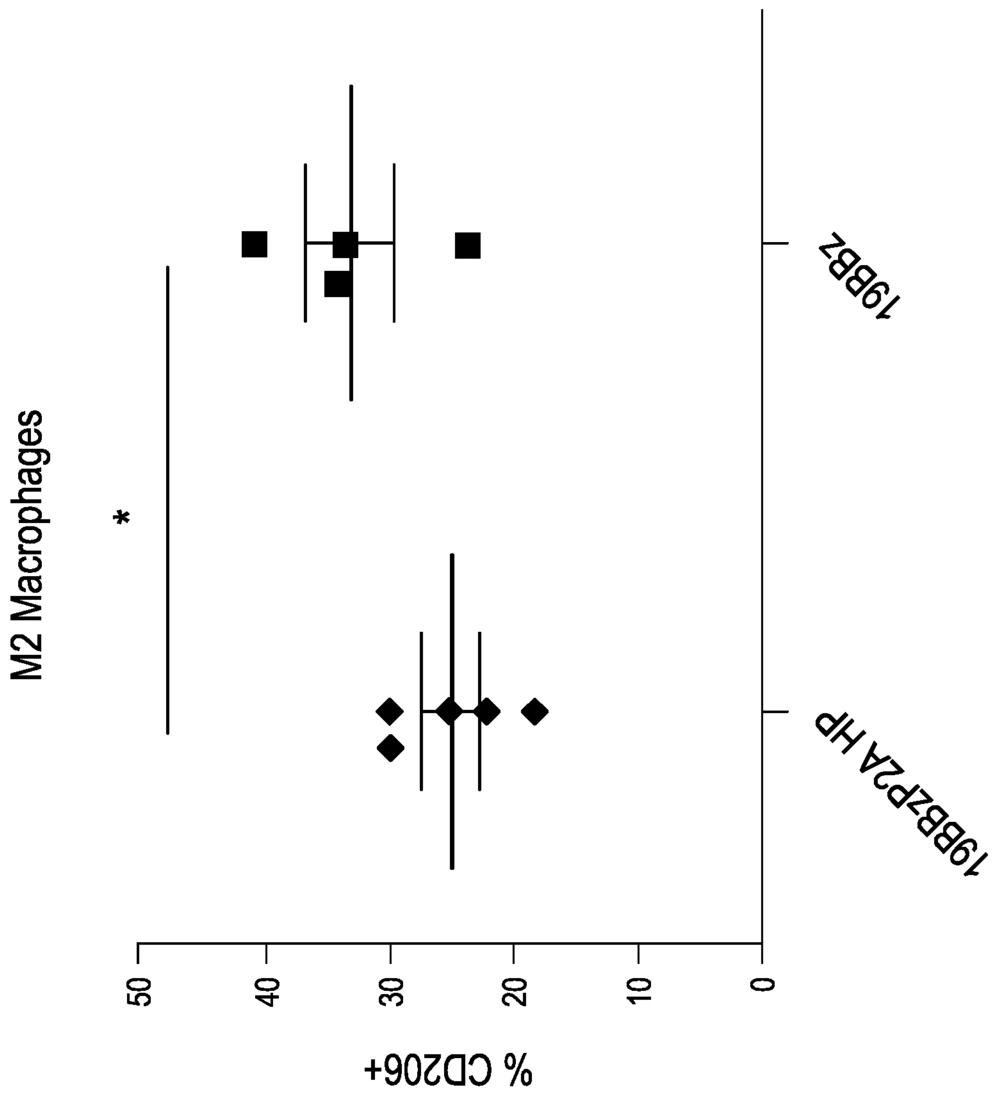
Figure 7F:
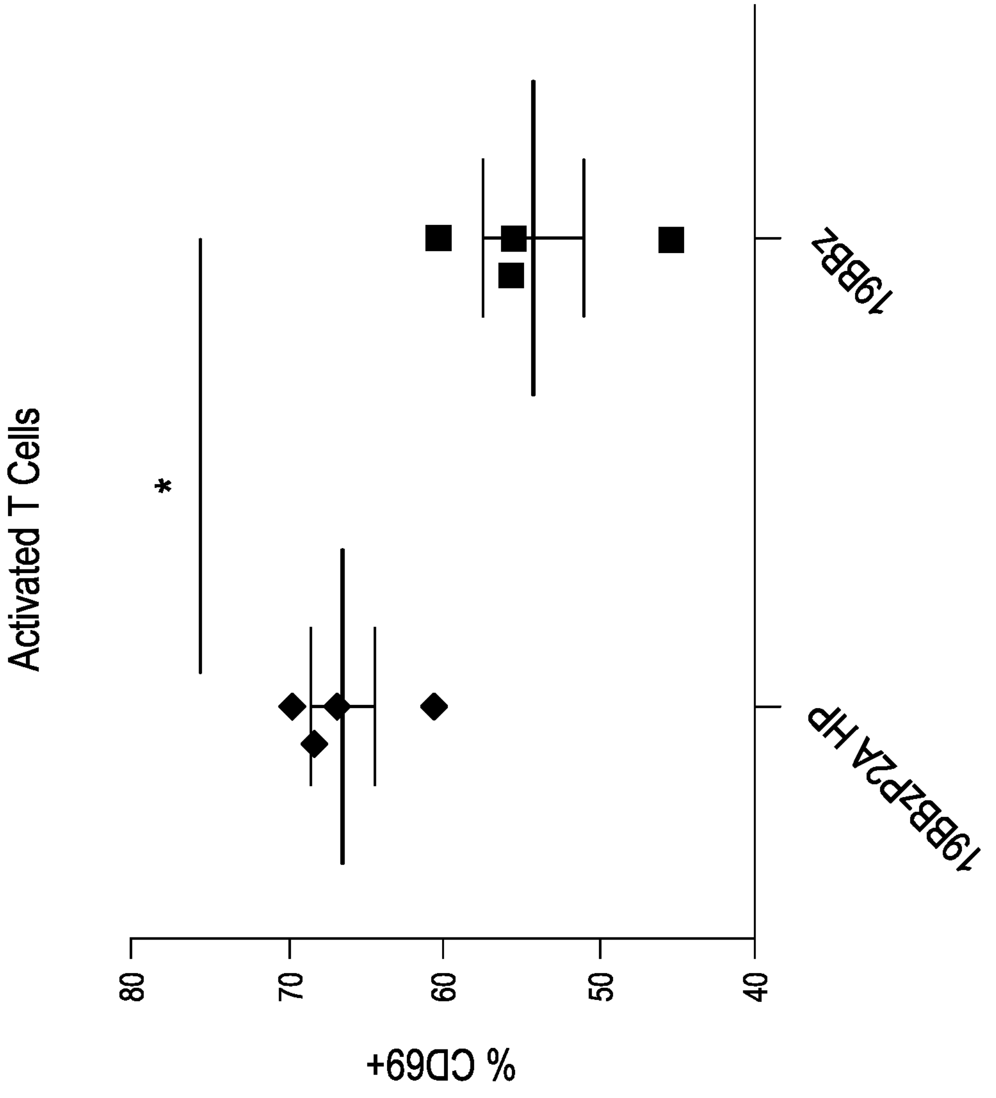

Tumors from the same mice were assessed for intratumoral immune activation. Delivery of HP RNA by CAR T cells increased the amount of dendritic cells (FIG. 7D), enhanced T cell activation (FIG. 7F) and reduced M2 macrophage polarization (FIG. 7E).

In conclusion, murine CAR T cells are capable of suppressing solid tumor growth and production of stimulatory RNA by these cells improves response to therapy.

Example 2: Delivering Stimulatory RNA Using CAR T Cells

Recently, it has been shown that secretion of the long non-coding RNA 7SL1 (RN7SL1) in exosomes present in the tumor microenvironment can activate pattern recognition receptors (PRRs) in the tumor (Nabet B Y, et al. Cell. 2017; 170(2):352-366.e13). 7SL1 is an abundant and highly structured endogenous lncRNA found in the cytoplasm of all cells and is normally involved in translation of membrane-bound proteins. Cancer cells are able to activate stromal fibroblasts to enhance expression of 7SL1 through the transcription factor MYC. This increase of stromal 7SL1 RNA results in a pool of 7SL1 that is devoid of its RNA binding proteins (RBPs) that include SPR9/14. This "unshielded" 7SL1 is secreted by the fibroblasts in exosomes. Because RBPs normally shield 7SL1 RNA from PRR recognition, the unshielded 7SL1 in exosomes can activate RIG-I upon exosome transfer to cancer or immune cells (Nabet B Y, et al. Cell. 2017; 170(2):352-366.e13). Whether unshielded 7SL1 in exosomes can stimulate DCs and macrophages to promote T cell priming and activation are unanswered questions.

This study focuses on the role of stimulatory endogenous RNA generated in the tumor microenvironment to promote APC activation and anti-tumor T cell responses, particularly for tumors with a poor pre-existing immune infiltrate. To therapeutically deliver these RNAs to solid tumors and potentially improve response to CAR T cell therapy, a novel next generation CAR T cell was engineered. This study tests the hypothesis that unshielded 7SL1 RNA generated in the tumor microenvironment, or delivered by CAR T cells, activates pattern recognition receptors (PRRs) present on local immune populations. This favors antigen presentation and enhances endogenous T cell responses against poorly immunogenic cancer types and overcomes current limitations to immunotherapy in solid tumors.

Develop a CAR T Cell Capable of Endogenous Immune Activation

Although capable of reactivating a T cell repertoire against potentially diverse neo-antigens, immune checkpoint blockade (ICB) is generally not effective in solid tumors with a poor immune infiltrate. CAR T cells can infiltrate previously immunologically quiet tumors but reliance on targeting a single antigen allows escape of subpopulations that do not express the target antigen, limiting its success with solid tumors. However, if properly equipped, CAR T cells might effectively initiate an anti-tumor immune response even in tumors with a poor immune infiltrate by promoting local immune infiltration/activation and stimulating a concurrent endogenous T cell response. Once initiated, ICB could further facilitate the endogenous T cell response. The purpose of this study is to develop a novel next generation CAR T cell that can deliver a stimulatory RNA and promote local immune infiltration/activation in order to generate a complementary endogenous T cell response to improve tumor clearance.

synNotch T Cells can Deliver RNA DAMPs that Activate DCs and T Cells

Figure 8A:
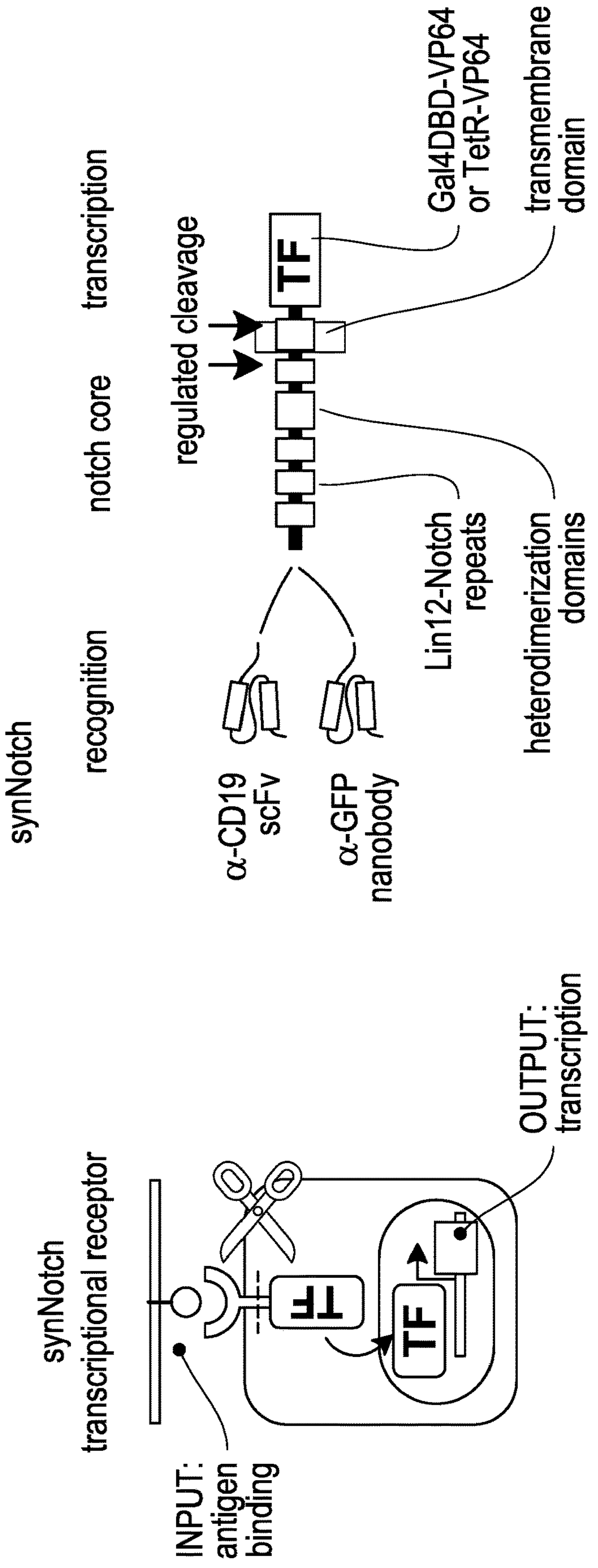
FIG. 8A is a schematic of the synNotch system.
Figure 8C:
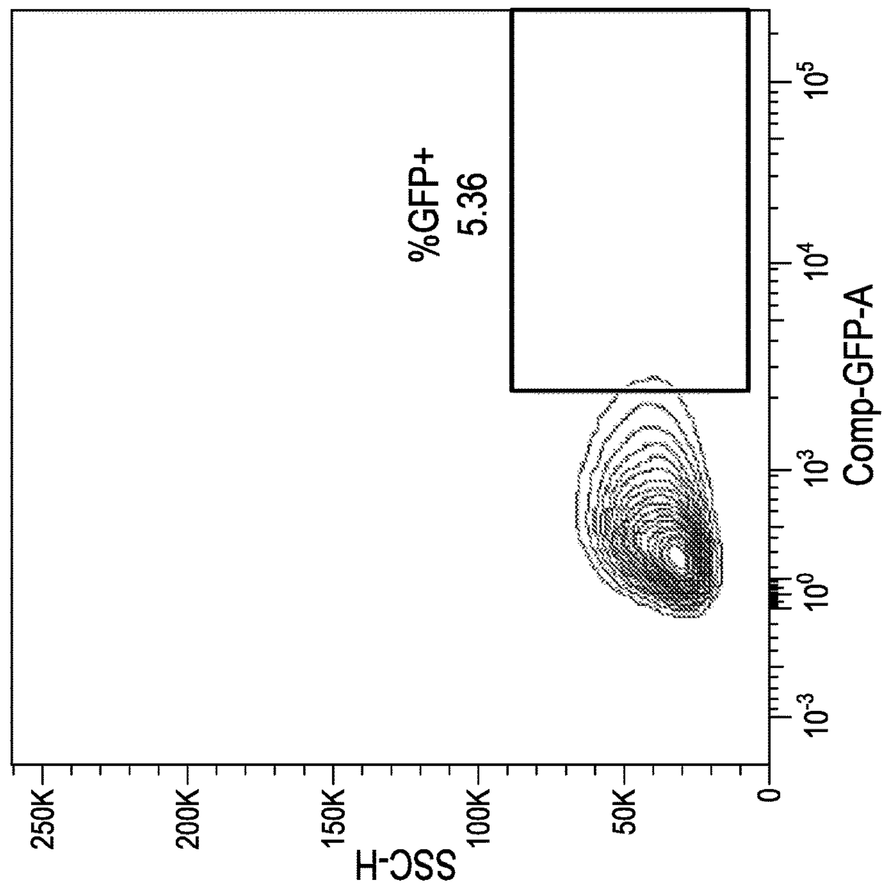
In FIGS. 8B and 8C, primary human T cells were transduced with hCD19 synNotch and Gal4-GFP constructs and cultured with K562-null (FIG. 8C) or K562-CD19 expressing (FIG. 8B) target cells. GFP expression in T cells was measured 24 hr later.
Figure 8B:
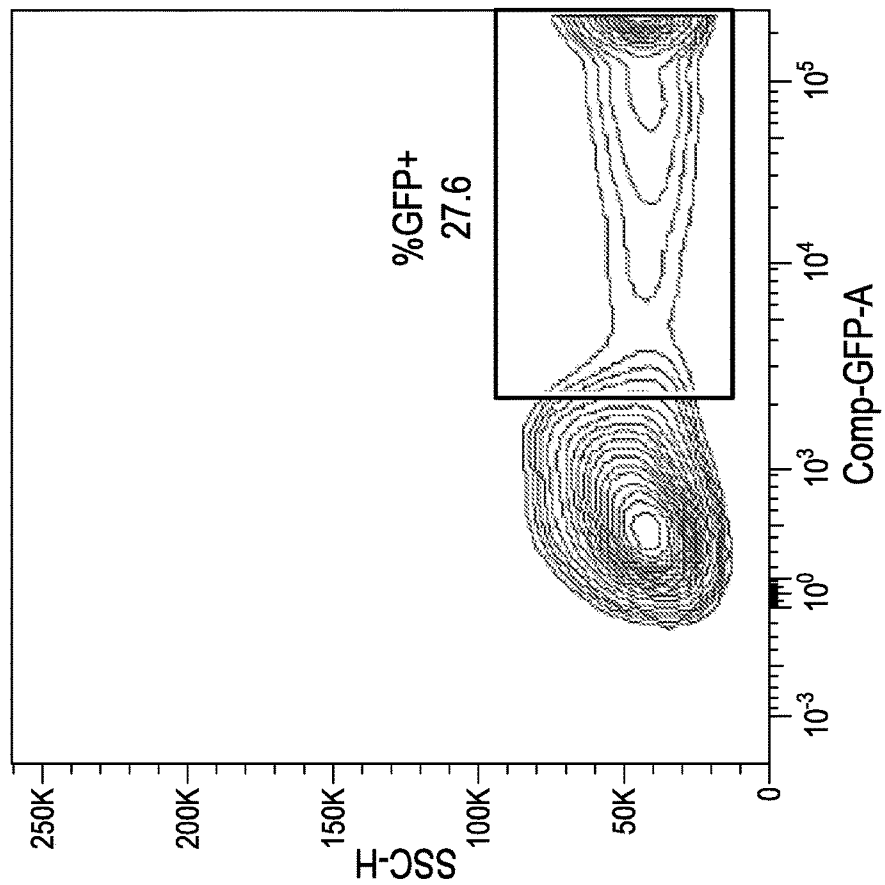

To engineer a CAR T cell to deliver stimulatory RNA such as unshielded 7SL1 RNA, an inducible "synNotch" CART cell system was developed (Roybal K T, et al. Cell. 2016; 164(4):770-9). In brief, a single chain variable fragment (scFv) derived from the heavy and light chains of an antibody is connected to the Notch transmembrane domain and linked to an intracellular transcription factor consisting of a VP64 transcriptional activation domain and a Gal4 DNA-binding domain A separate "response element" consists of the bacterial Gal4 upstream activation sequence driving a gene of interest. Both constructs are integrated into the genome using lenti- or retroviral vectors. Upon recognition of a target antigen by the scFv, the Notch transmembrane domain is cleaved, allowing the chimeric transcription factor to translocate to the nucleus and activate the gene of interest (FIGS. 8A and 8B). In this study, the synNotch receptor comprises the amino acid sequence of SEQ ID NO: 21. The scFv domain of the synNotch receptor is an anti-CD19 scFv comprising the amino acid sequence of SEQ ID NO: 15. The transmembrane and intracellular domains of the synNotch receptor comprise the amino acid sequence of SEQ ID NO: 17. Importantly, the synNotch construct lacks signaling domains and so generally will not kill in isolation. The Gal4-response element comprises the nucleotide sequence of SEQ ID NO: 18.

Figure 9A:
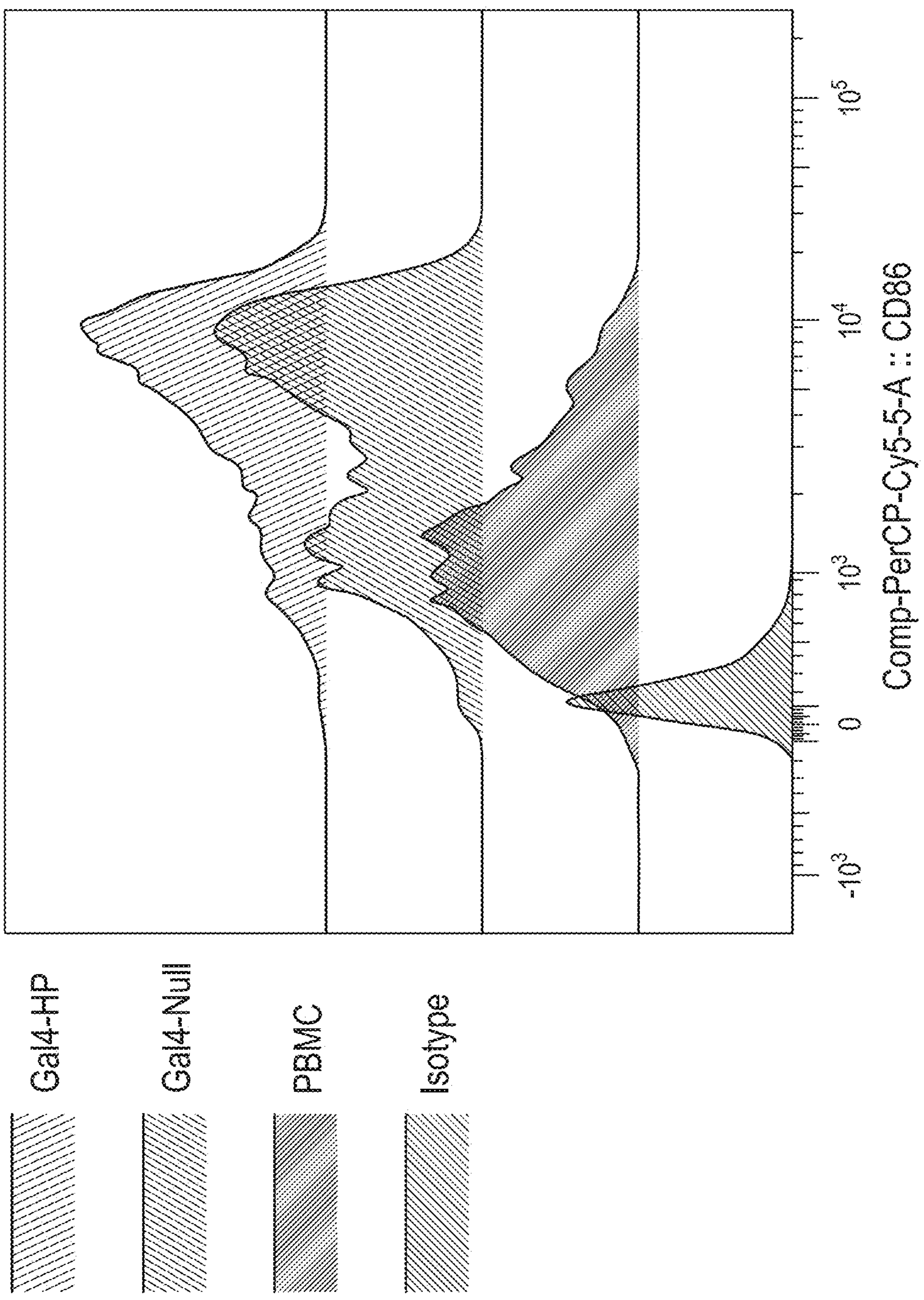
FIGS. 9A and 9B: Primary human T cells were transduced with anti-hCD19 synNotch and Gal4-HP constructs and then cultured with K562-CD19 target cells and PBMCs. The anti-hCD19 synNotch comprises the amino acid sequence of SEQ ID NO: 21. The Gal4-HP DNA construct comprises the nucleotide sequence of SEQ ID NO: 27.
Figure 9A:
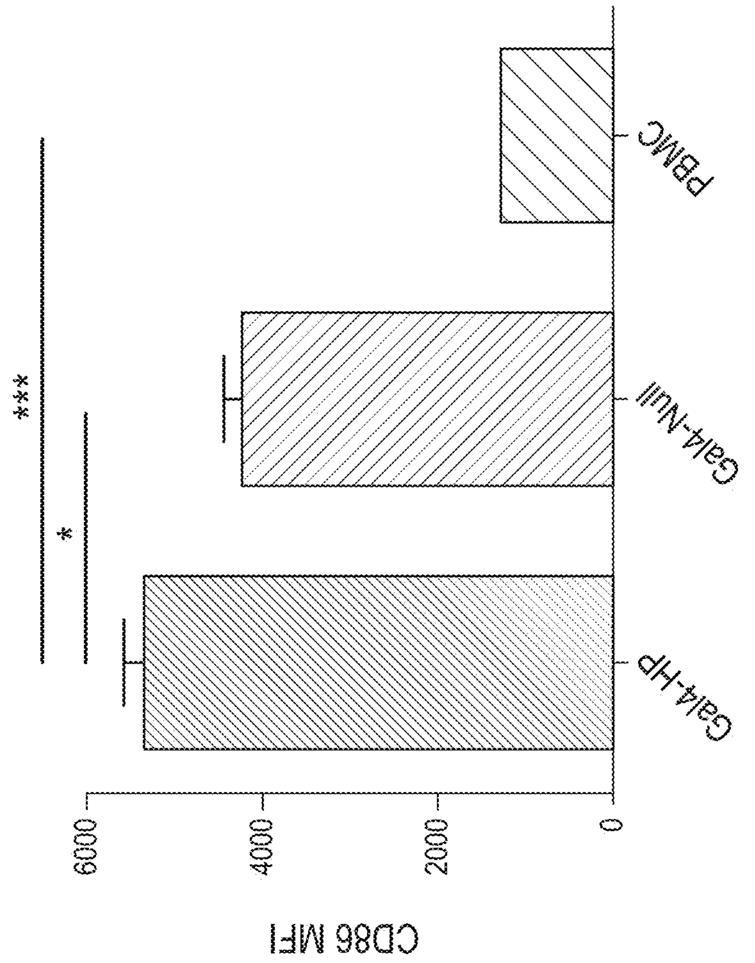
Figure 9B:
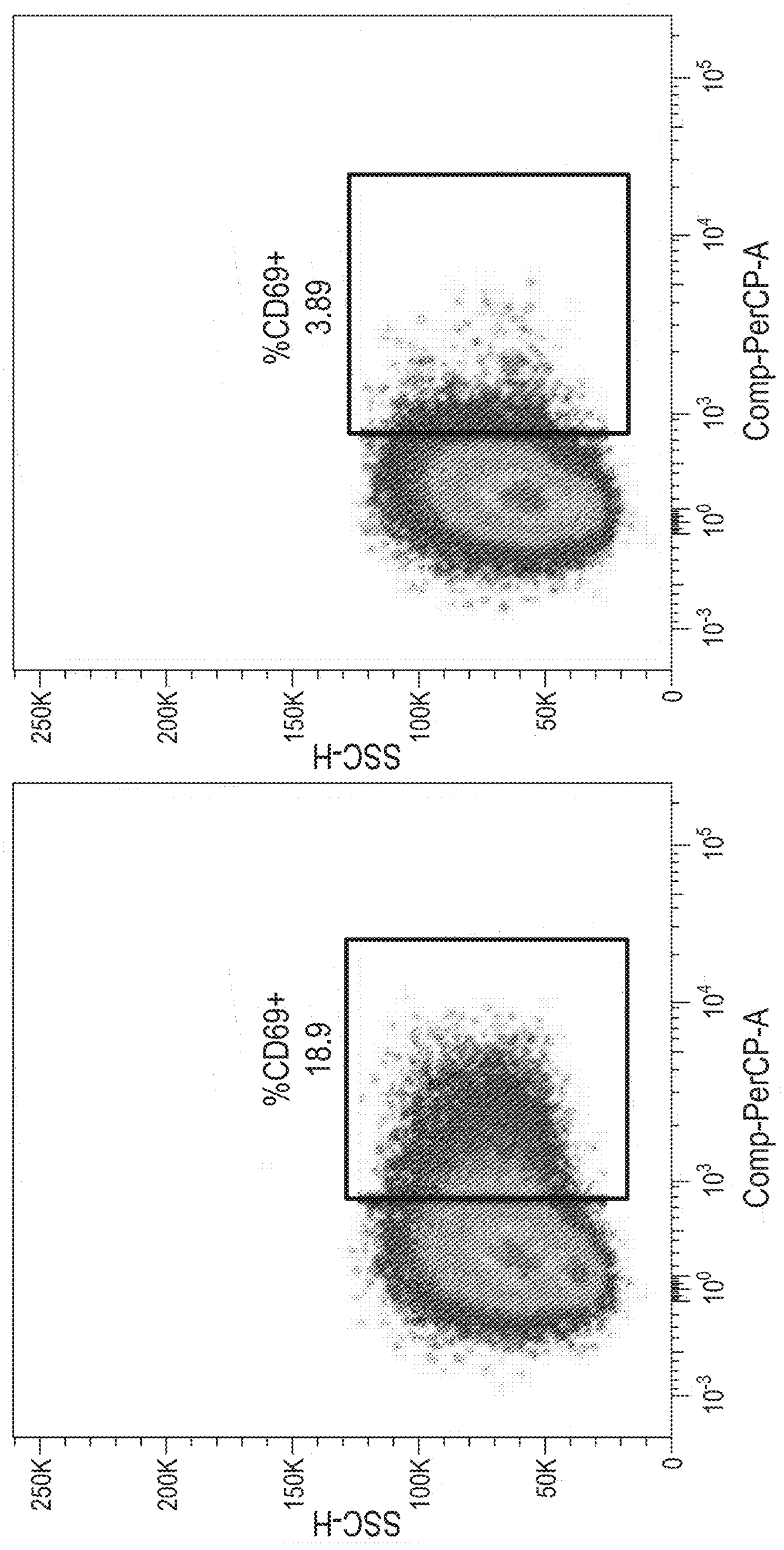
Figure 9B:
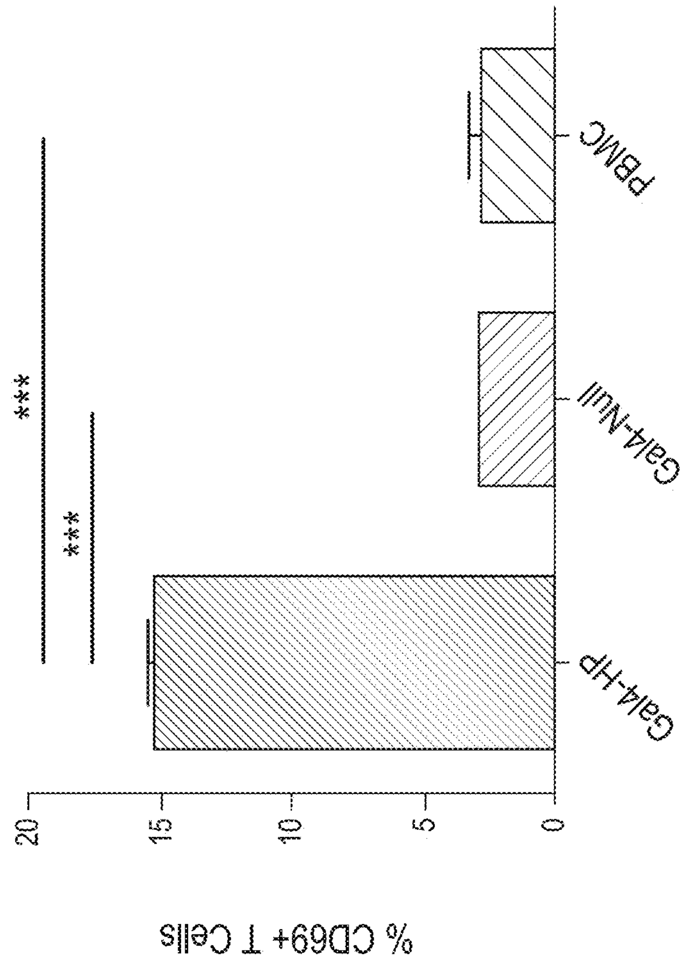

Given that 7SL1 RNA stimulates T cell activation, and that recognition of structured RNA by DCs stimulates T cell responses (Wang Y, et al. Immunol Rev. 2011; 243(1):74-90), two RNA response elements were designed. The first is a 25 base pair hairpin RNA comprising the nucleotide sequence of SEQ ID NO: 10. This hairpin (HP) RNA was designed to mimic the immunogenic activity of 7SL while avoiding potential shielding via recognition of homologous sequences by shielding proteins. The Gal4-HP response construct comprises the nucleotide sequence of SEQ ID NO: 27. The second is a 7SL1 RNA, allowing a CAR T cell to mimic secretion of 7SL1 RNA-containing exosomes by MYC-activated MEFs. This 7SL1 RNA was designed as Alu-Ya5 followed by a poly-A tail. The DNA sequence encoding this 7SL1 RNA comprises the nucleotide sequence of SEQ ID NO: 7. The Gal4-Alu response construct comprises the nucleotide sequence of SEQ ID NO: 19. To preliminarily test these synNotch Gal4-HP T cells, they were cultured with CD19+ target cells along with primary human PBMCs. Expression of synNotch-driven RNA resulted in circulating human DCs expressing higher levels of CD86 and Batf3 compared to synNotch T cells lacking a response element (FIG. 9A, data not shown). This activation of DCs was accompanied by an increase in the percentage of activated CD69+ T cells (FIG. 9B). Thus, a T cell designed to produce stimulatory RNA has the potential to activate DCs and endogenous T cells.

Murine CAR T Cells can Control Solid Tumors

Figure 10A:
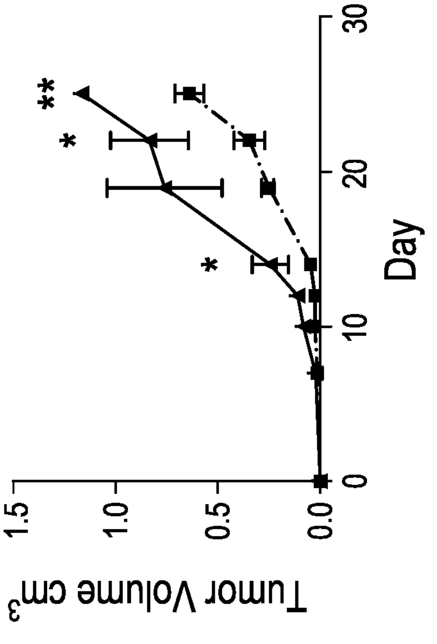
FIGS. 10A, 10B, 10C, and 10D are graphs showing results of a mouse study testing murine CD19 CAR T cells.
Figure 10B:
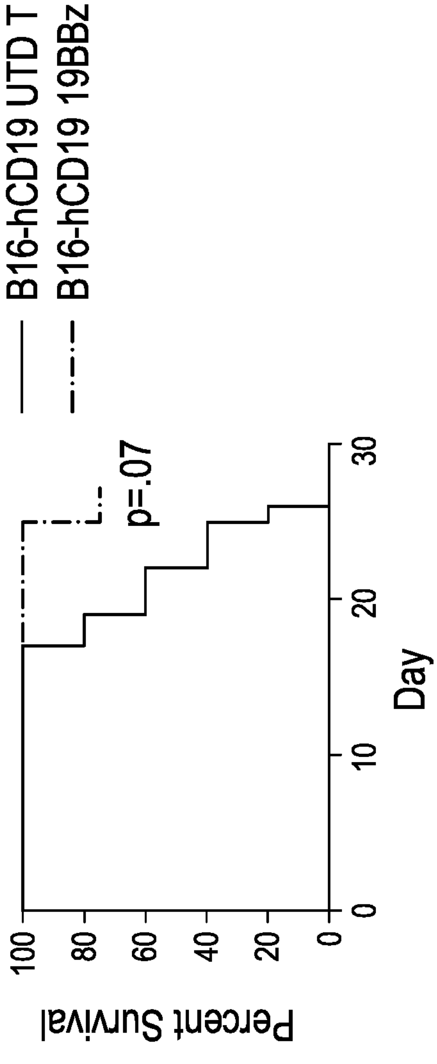
Figure 10C:
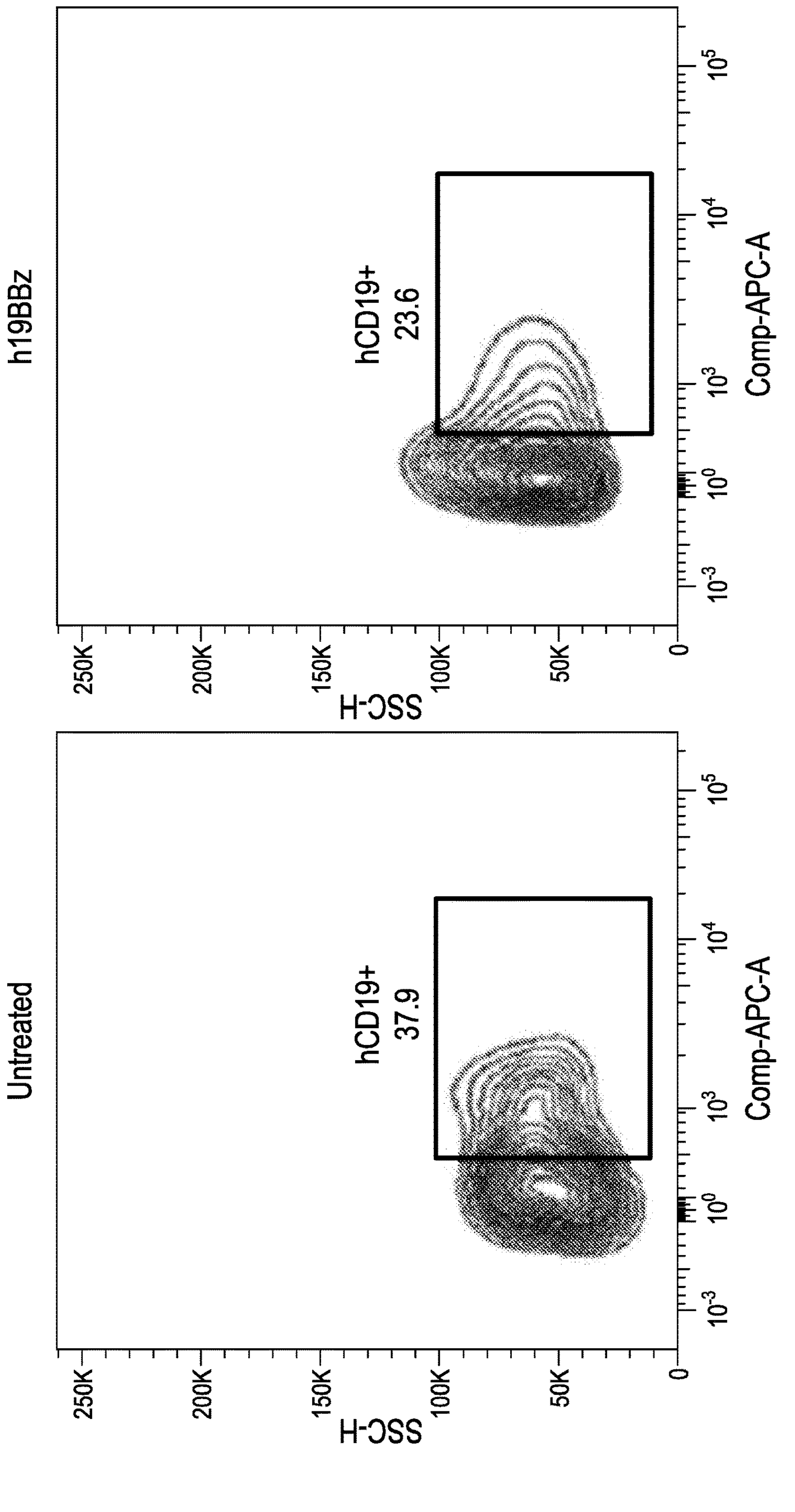
Figure 10D:
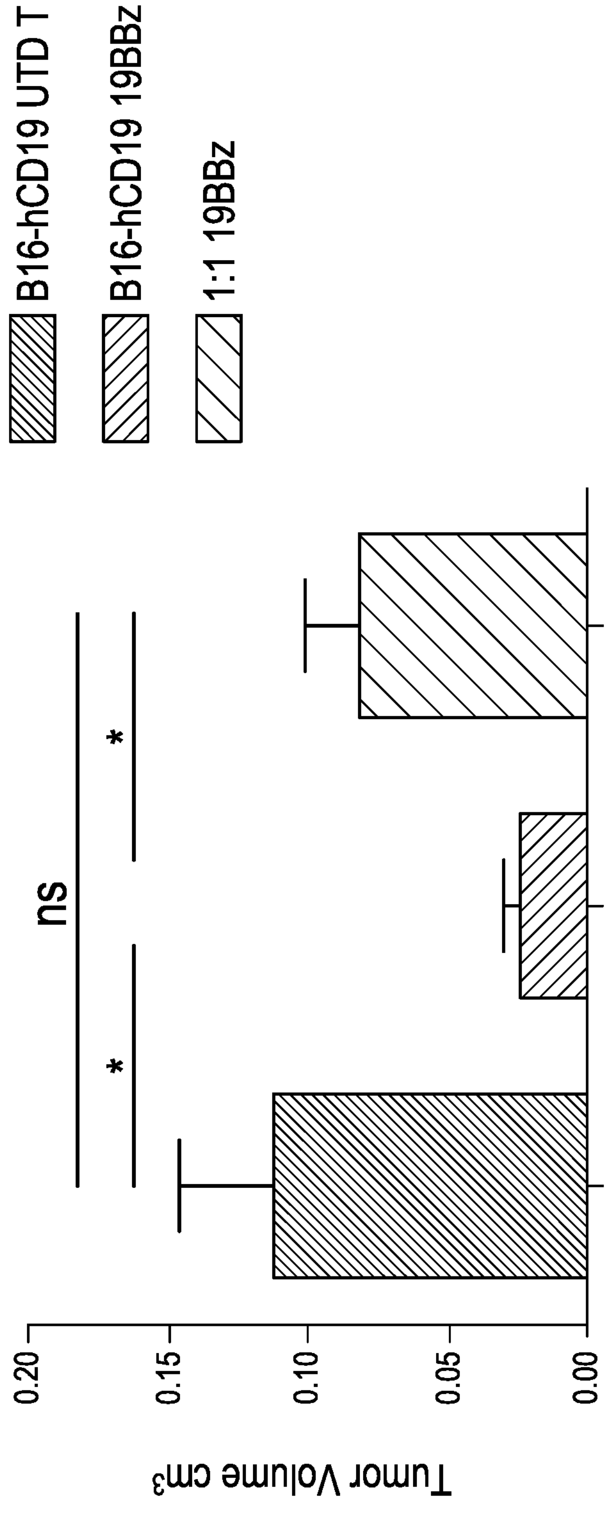
Figure 11A:
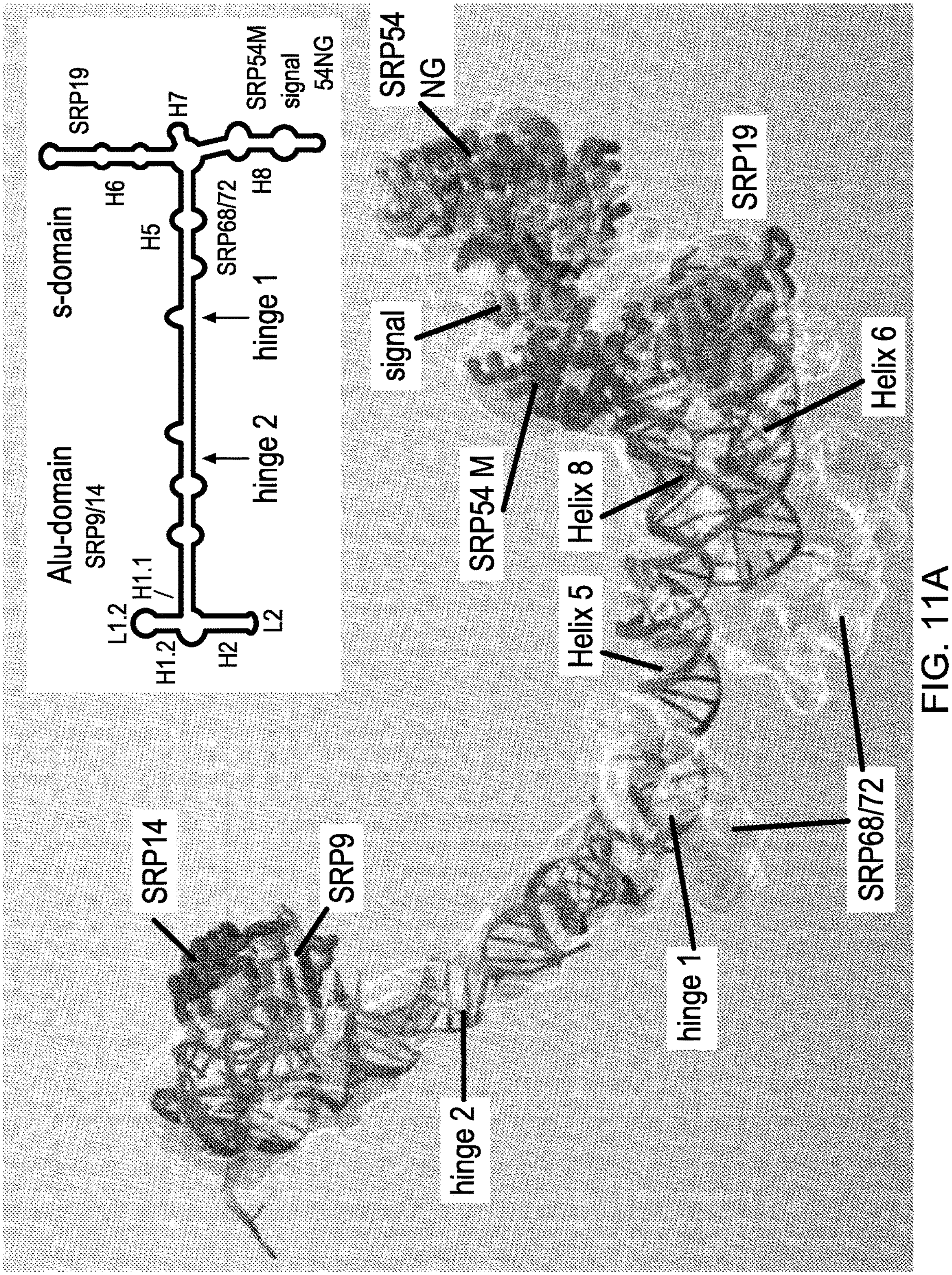
FIG. 11A: structural rendering of the signal recognition particle anchored by 7SL1 (Halic & Beckman, Curr Op Mol Bio 2005).
Figure 11B:
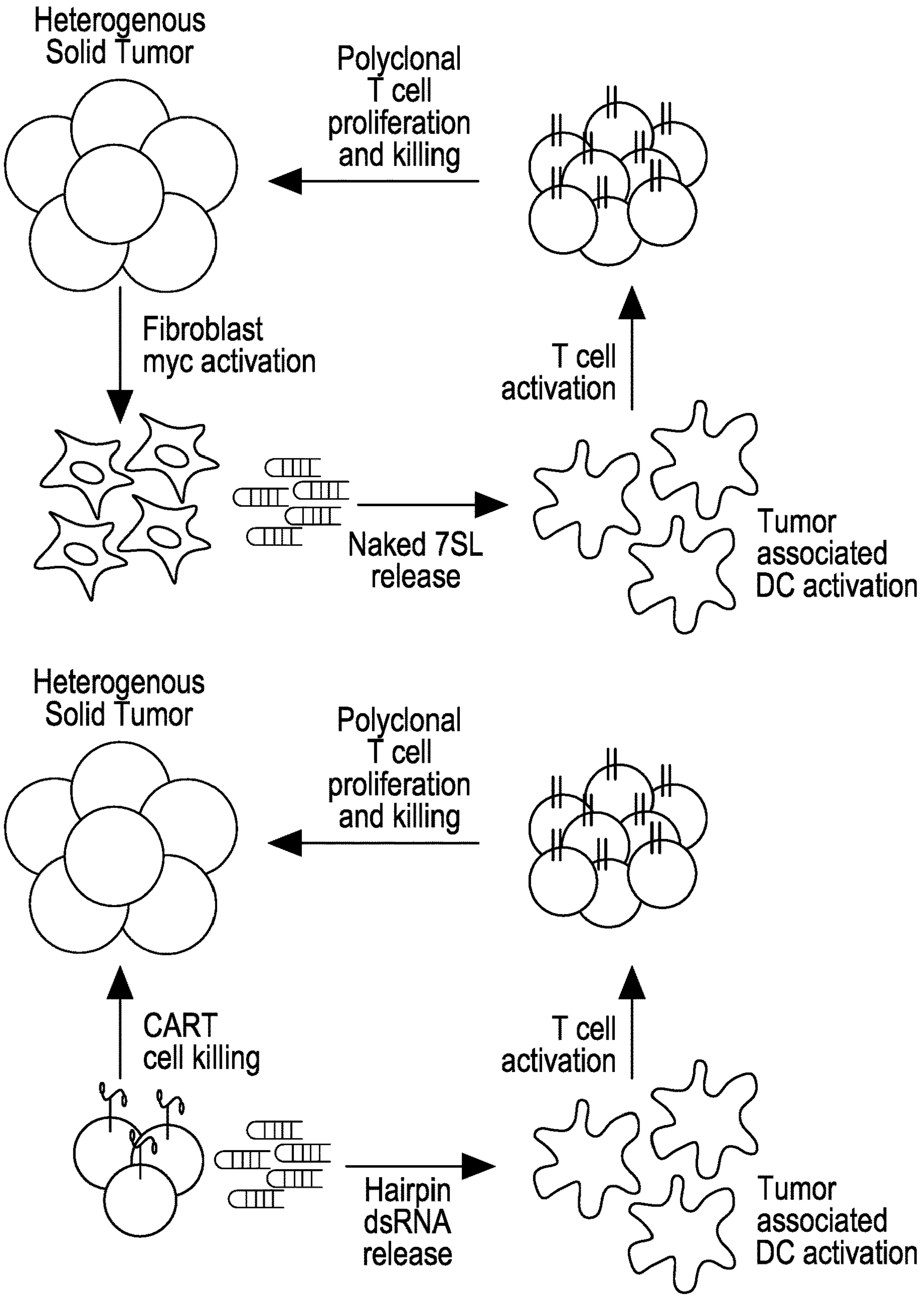
FIGS. 11B, 11C, and 11D: Proposed models for activation of intratumoral immune populations. Without wishing to be bound by theory, unshielded 7SL RNA present in the tumor may drive dendritic cell recruitment and subsequent T cell activation, which may in turn drive tumor control, e.g., in the presence of a CSF1R inhibitor. The effect of the unshielded 7SL RNA may be replicated using stimulatory RNA expressed by engineered T cells, e.g., CAR T cells.
Figure 11C:
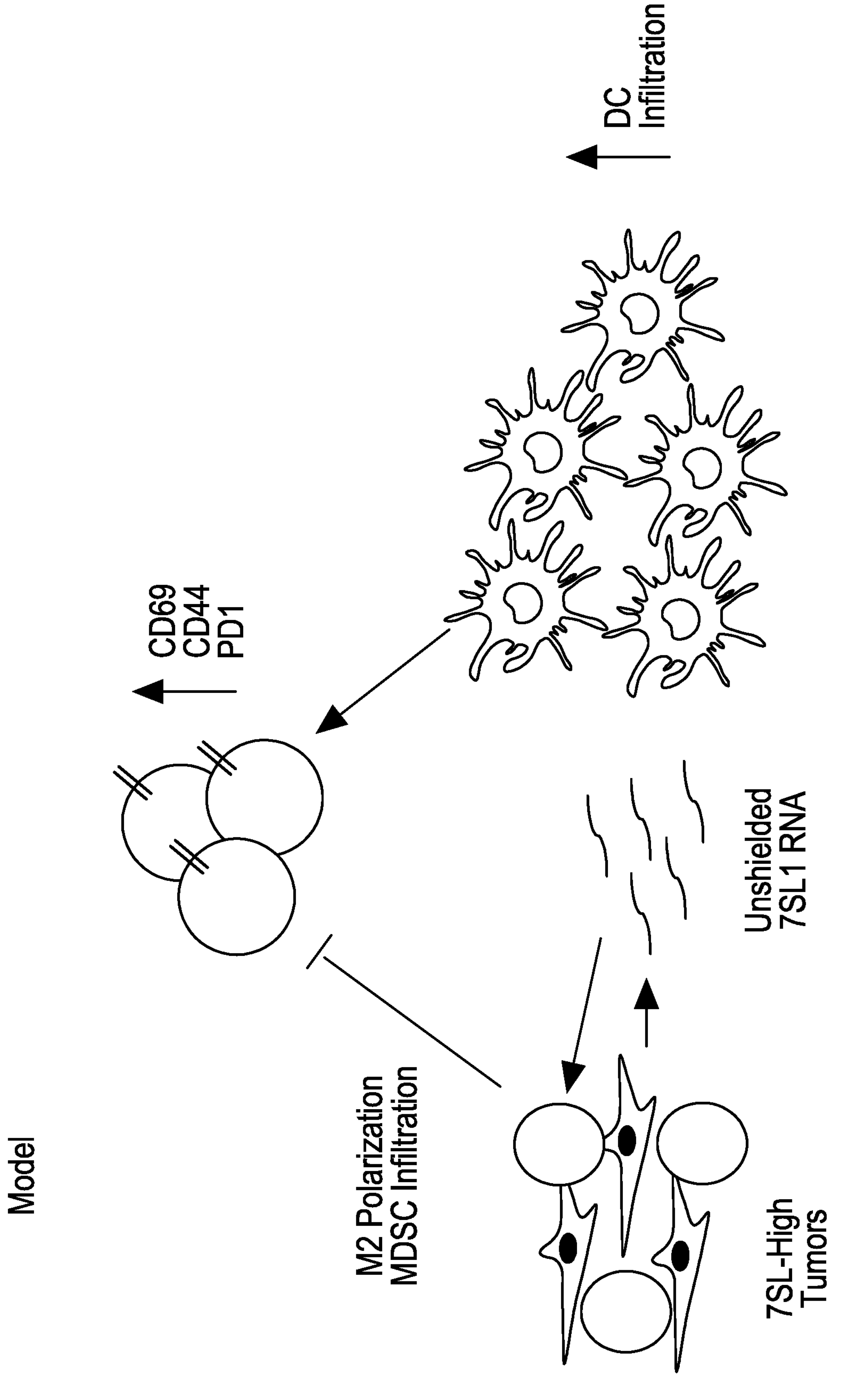
Figure 11D:
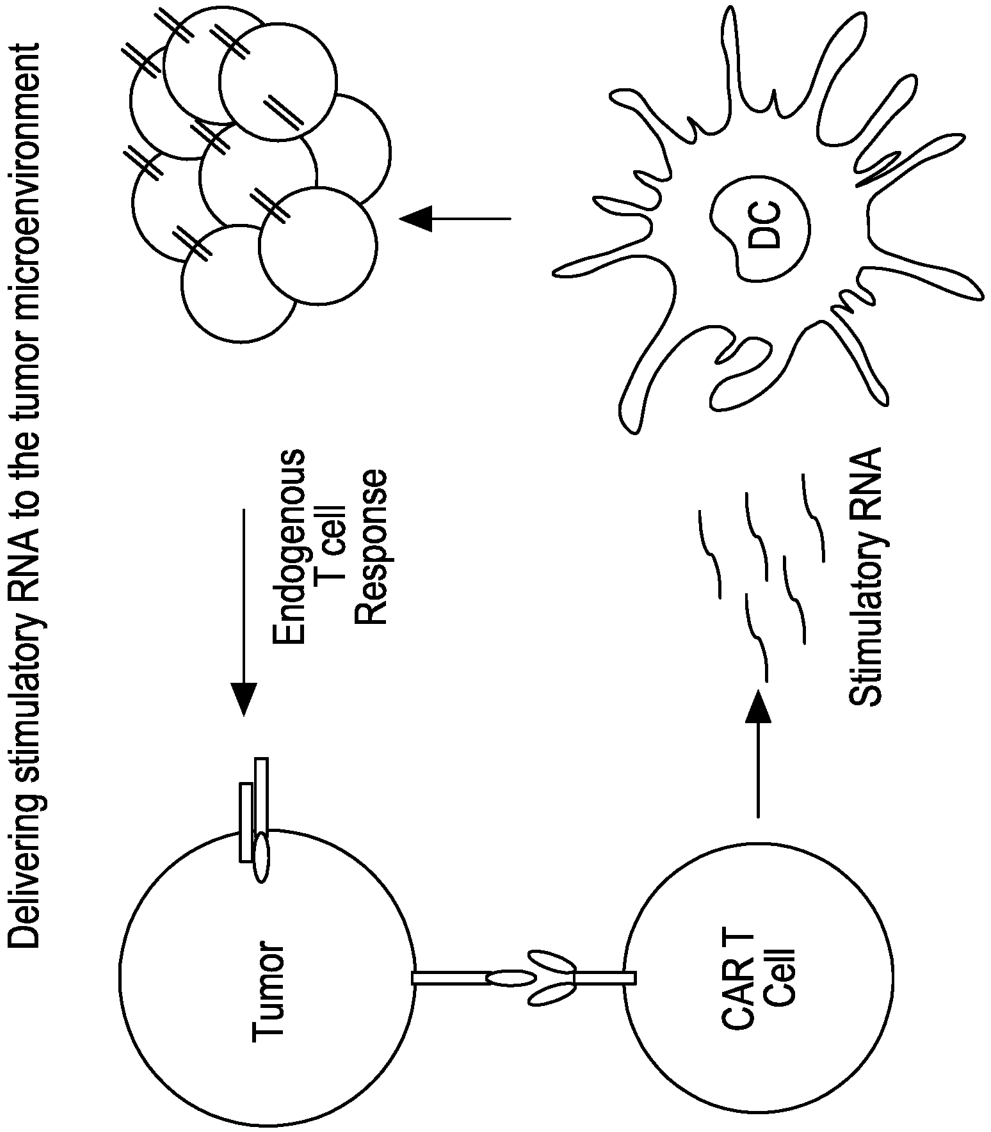
Figure 11E:
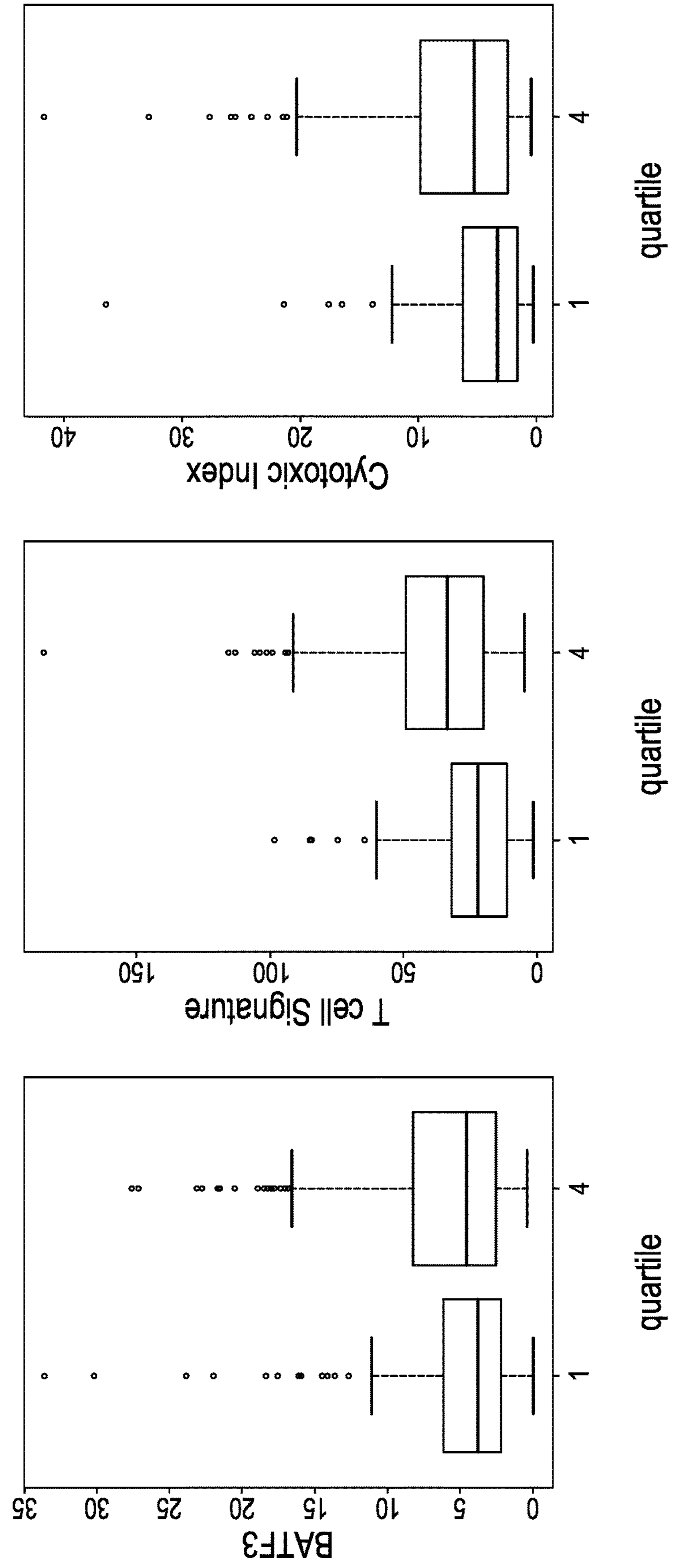
FIG. 11E: RNA-Seq analysis from TCGA lung adenocarcinoma samples was separated by level of unshielded 7SL1 RNA into quartiles and expression of indicated genes was graphed.
Figure 12A:
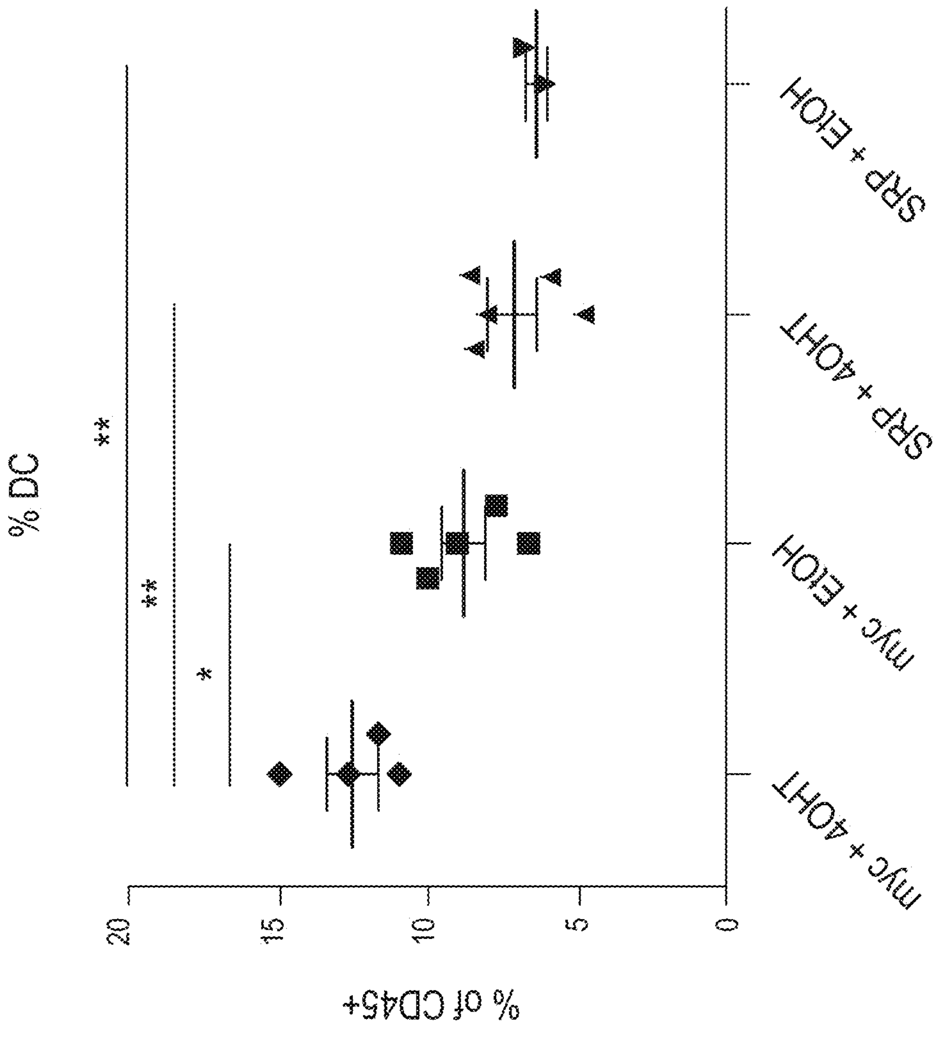
FIGS. 12A, 12B, and 12C: Unshielded 7SL increases DC infiltration and intratumoral T cell activation, dependent upon host MyD88 signaling. MEFs transduced to express a 4OHT-inducible myc protein were activated using 4OHT and implanted at a 1:1 ratio with B16-F10 melanoma cells into mice. Tumors were isolated 13 days later and assessed by flow cytometry to determine frequency of DCs (FIG. 12A) and activation of T cells (FIG. 12B).
Figure 12A:
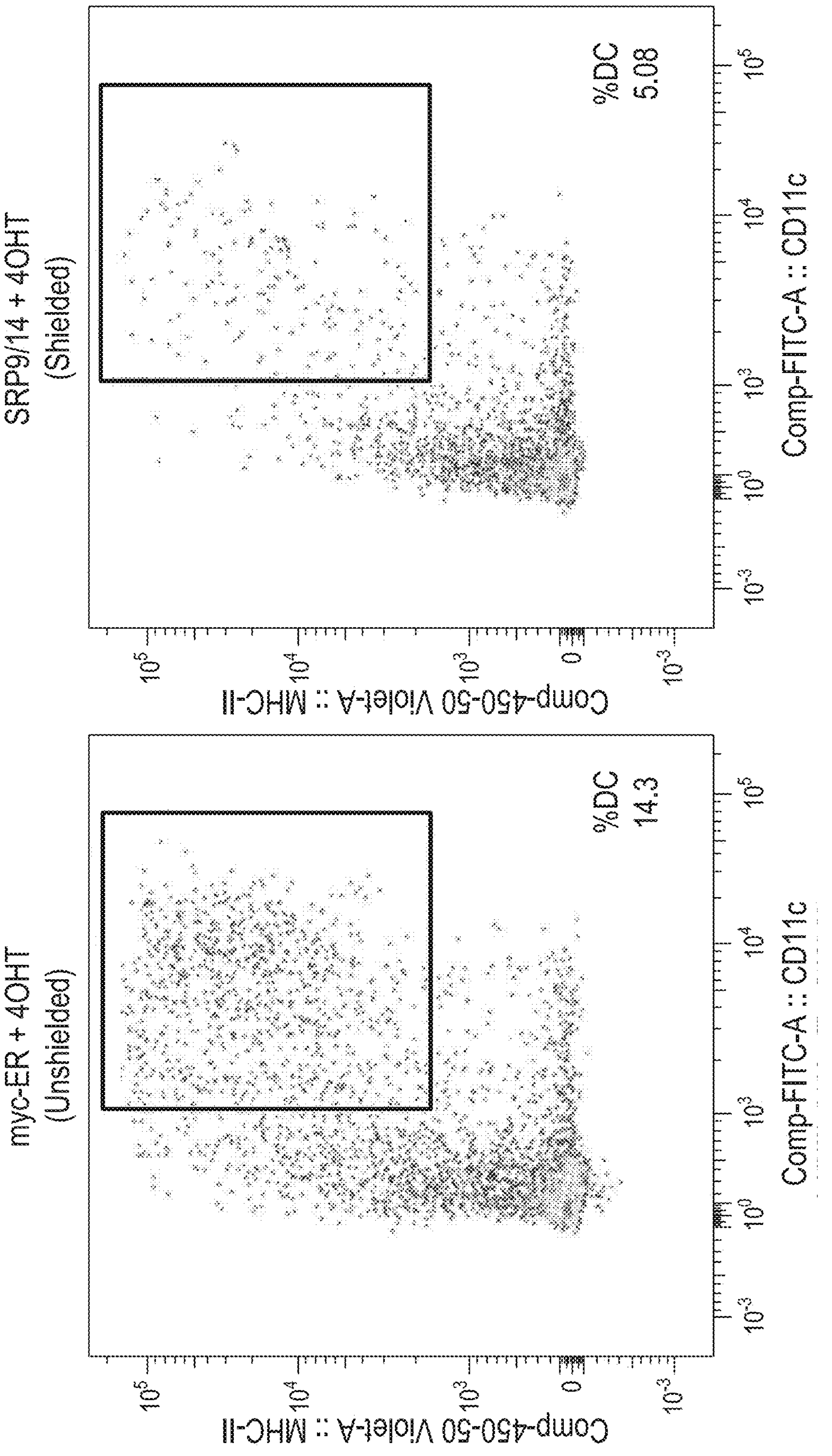
Figure 12B:
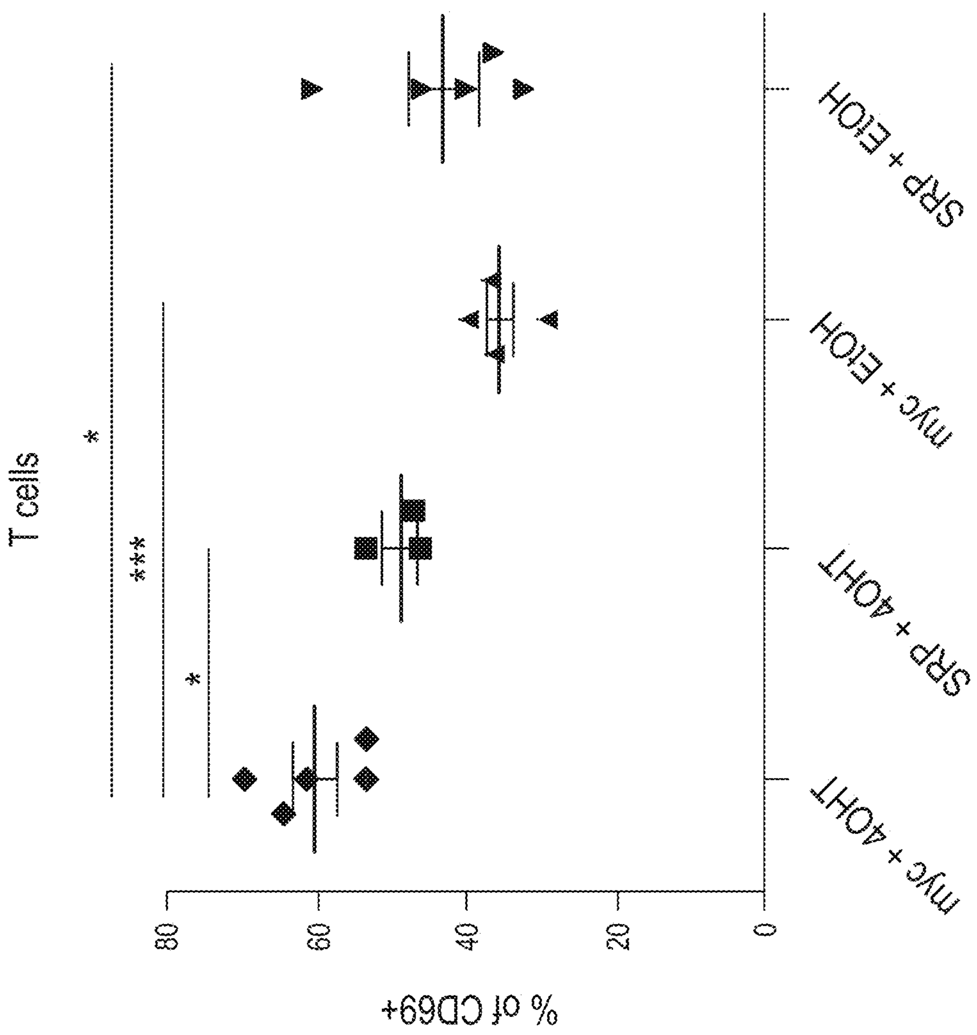
Figure 12B:
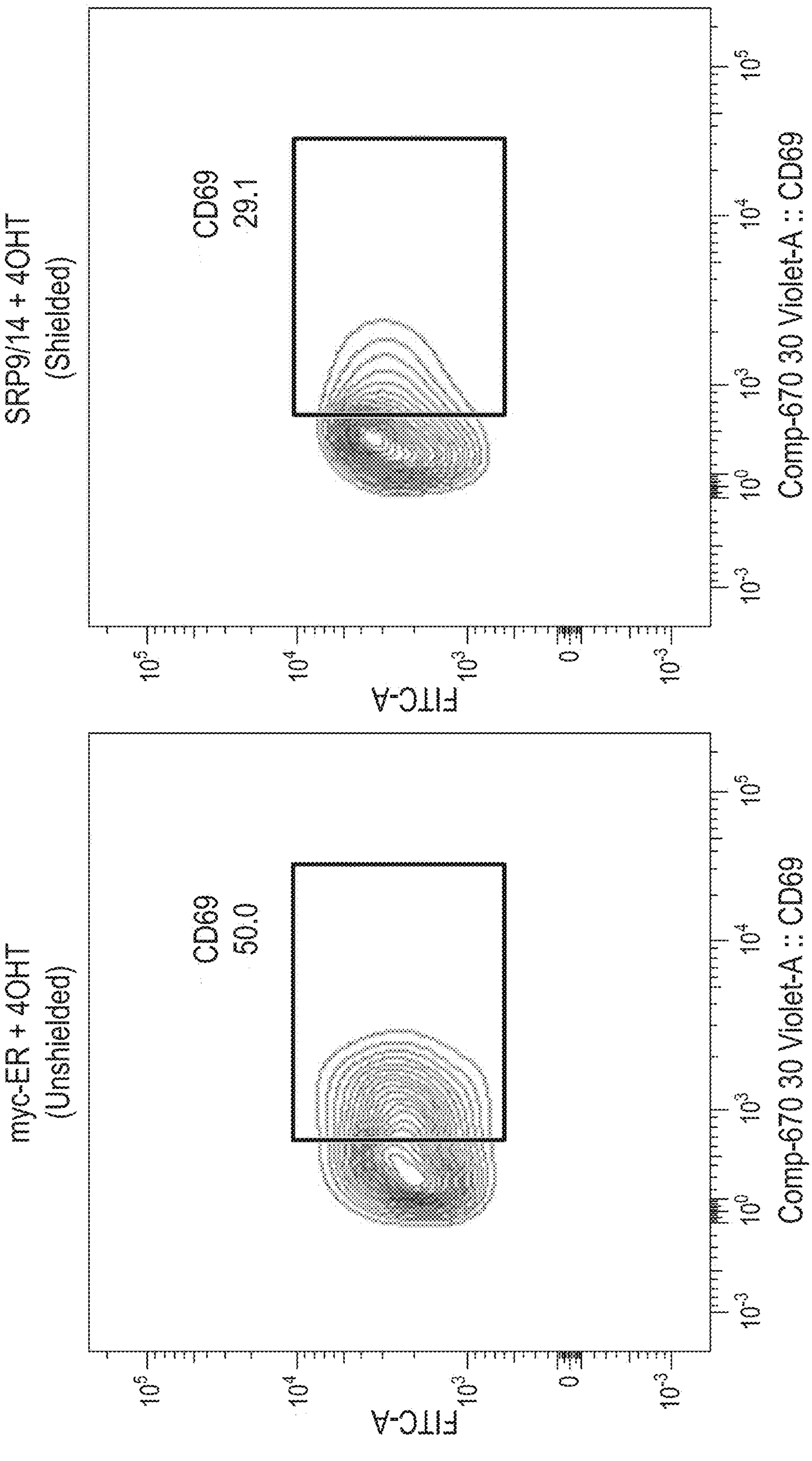
Figure 12C:
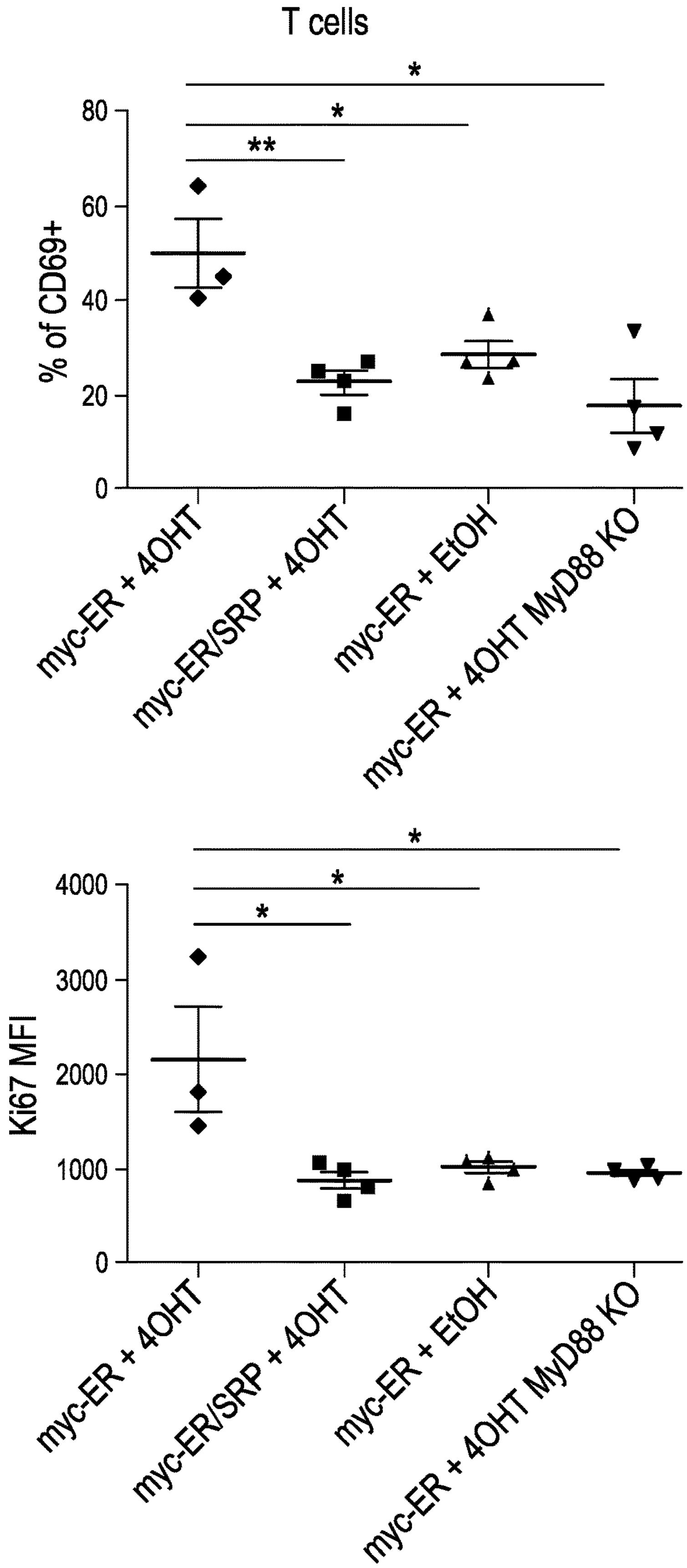
Figure 13A:
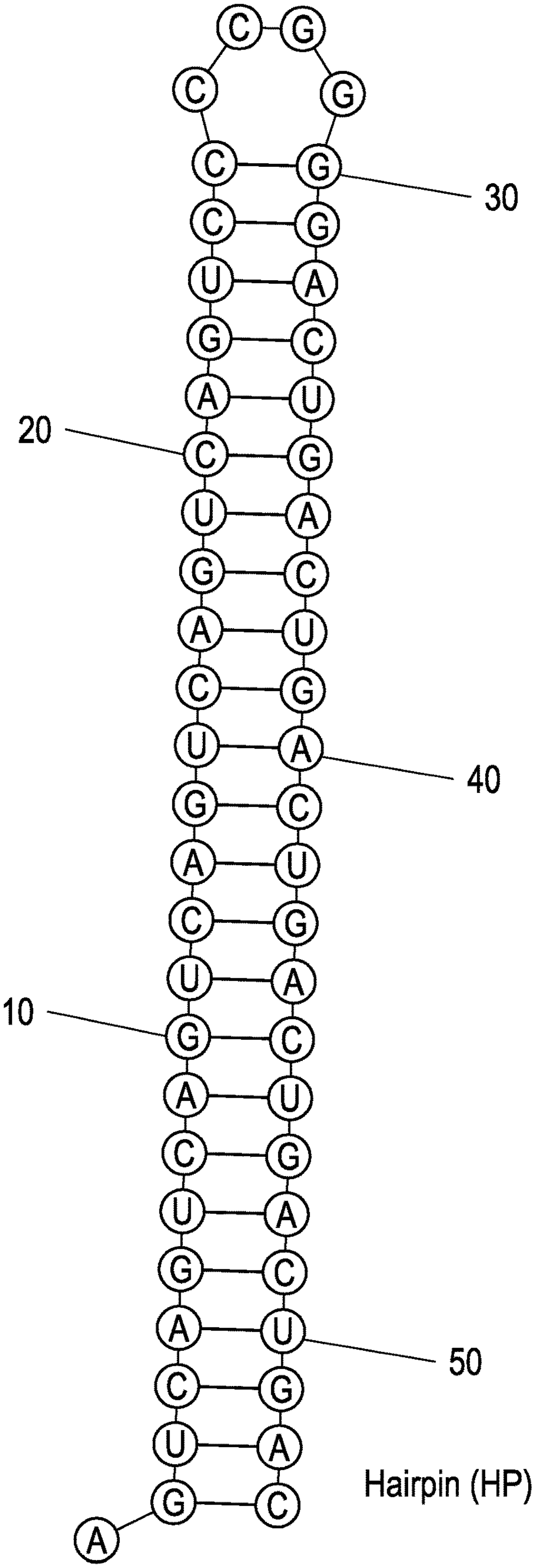
FIGS. 13A, 13B, and 13C are graphs showing the predicted secondary structures of the hairpin RNA, human 7SL1 RNA, and Alu RNA, respectively.
Figure 13B:
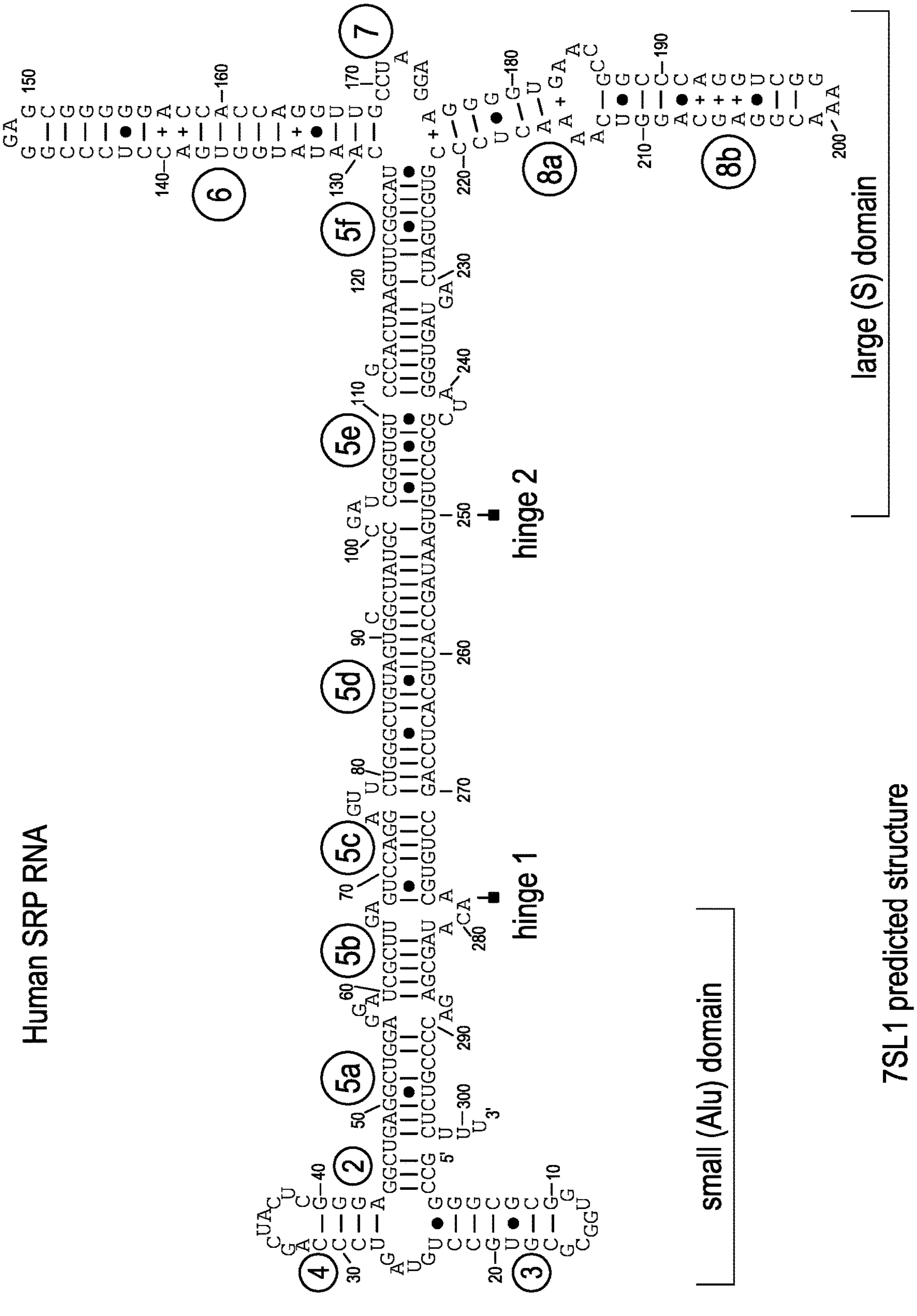
Figure 13C:
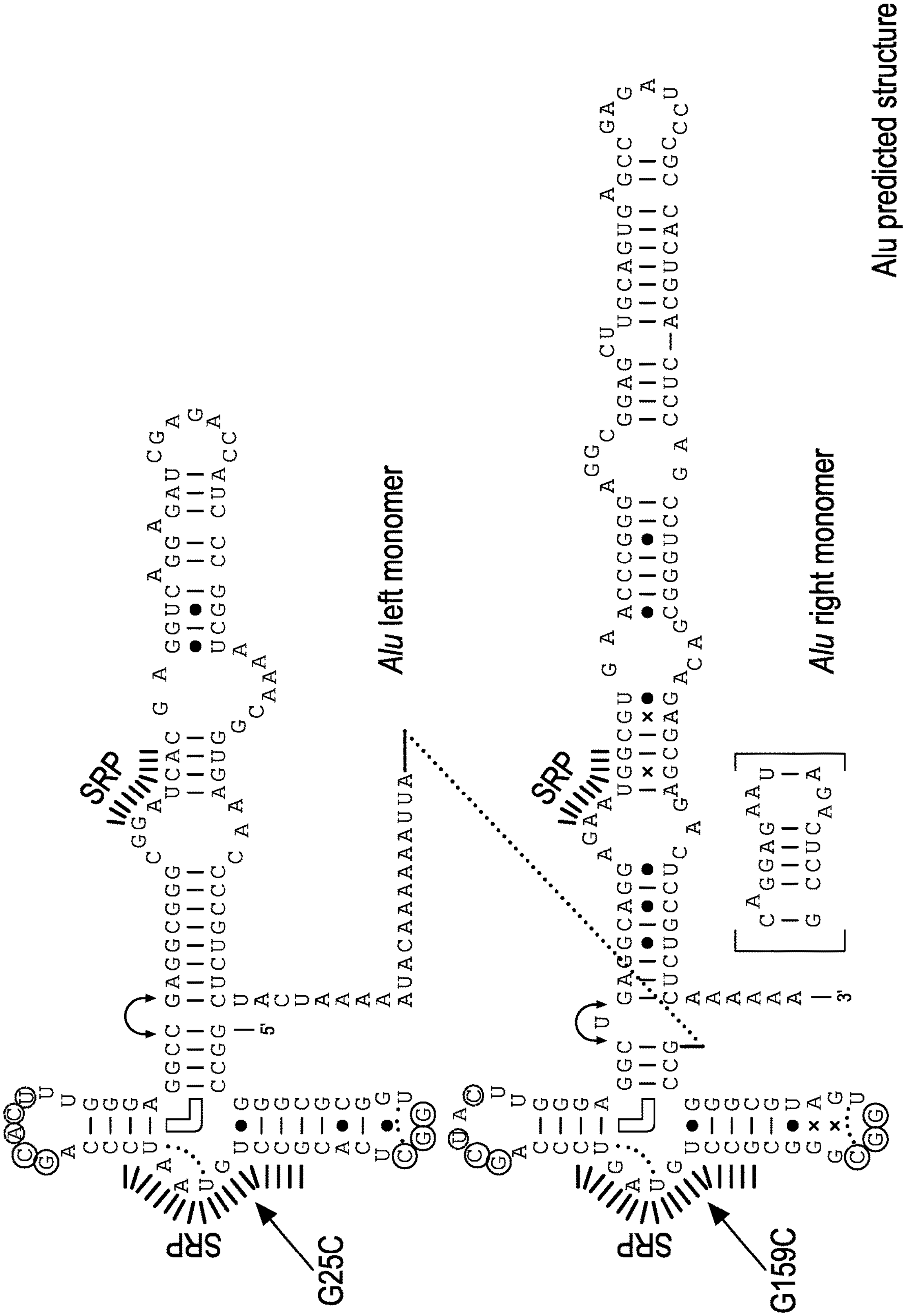

Hairpin (HP) synNotch T cells are able to stimulate the upregulation of costimulatory receptors and maturation transcription factors on DCs in vitro (FIGS. 9A and 9B). As an initial step in examining whether delivery of HP RNA by CAR T cells results in favorable endogenous immune effects in vivo, a syngeneic murine CART cell model system was generated. B16-F10 melanoma cells were transduced with the human CD19 antigen (hCD19, pCLPs-EF1a-CD19trunc). Preliminary data suggests that these B16-hCD19 tumors grow at a similar rate to WT B16-F10 tumors, and that immune infiltration is not altered. Furthermore, the endogenous immune system does not edit the hCD19 antigen as is the case for other artificial antigens. When treated with murine T cells expressing the hCD19BBz CAR (pMSGV-EF1ah19BBz), these tumors were controlled for significantly longer compared to mice treated with untransduced murine T cells (FIGS. 10A, 10B, and 10D). When a 1:1 mix of B16 WT and B16-hCD19 tumor cells were implanted, treatment with h19BBz murine CAR T cells resulted in an intermediate effect compared to tumors comprised only of B16-hCD19 cells. Moreover, preferential loss of hCD19-expressing cells was observed (FIG. 10C). This is consistent with antigenic editing by CAR T cells and allows the interrogation of whether delivery of unshielded 7SL1 RNA can improve clearance of tumor subpopulations that lose or fail to express the target antigen by enhancing an endogenous T cell repertoire.

Identify Endogenous Immune Populations Activated by RNA DAMP synNotch T Cells In Vivo B16 melanoma cells expressing human CD19 (B16-hCD19) are implanted in the flanks of C57BL/6 mice. Murine primary T cells are transduced with the hCD19 synNotch construct and Gal4-Hairpin, Gal4-7SL1 or Gal4-GFP response elements (pMSGV-PGK-antiCD19-synNotch-Gal4VP64, pMSGV-PGK-mCherry-Gal4response). Then, 5 million synNotch/Gal4 double-positive T cells are subsequently injected into tumor-bearing mice when tumors are palpable at day 5, in accordance with previously published doses (Sampson J H, et al. Clin Cancer Res. 2014; 20(4):972-84). Tumors are monitored for growth kinetics by caliper before they are harvested 10 days following injection. Following harvest, DCs and macrophages in the tumor are assessed for markers of activation, as well as macrophage polarization by flow cytometry. Additionally, endogenous tumor specific CD8+ T cells are identified in this model by congenic markers and staining with the TRP-2 tetramer known to be specific to a melanocyte-differentiation antigen expressed by B16 tumor cells. These cells are assessed for markers of activation. Complementing this approach, endogenous T cells are sorted from these tumors and TCR sequencing is performed to measure T cell diversity. These experiments are repeated with a second cancer model that generally shows lower levels of immune infiltrate compared to B16 (e.g., KPC-derived pancreatic tumor line PDA152).

Determine Efficacy of RNA DAMP Producing CAR T Cells

It is unlikely that synNotch T cells producing a local adjuvant such as stimulatory RNA, but lacking direct killing capacity, will induce lasting remissions as a monotherapy. This has been demonstrated by a multitude of cancer vaccine and adjuvant therapies that have failed in clinical trials. Therefore, increased killing capability is desirable to assess the translational relevance of this approach. To address this, the h19BBz CAR construct will be introduced into RNA DAMP synNotch T cells. Therefore, murine T cells are transduced with three viral constructs: h19BBz CAR, hCD19 synNotch, and either the Gal4-Hairpin or Gal4-7SL1, or the Gal4-GFP response element as a negative control. This allows these CAR T cells to kill target cells and test the effect of deploying endogenous RNA DAMPs into the tumor microenvironment.

In addition to testing whether RNA DAMPs can enhance direct CAR T cell killing, this study also investigates if the endogenous T cell repertoire can be recruited by the RNA DAMP, participate in the anti-tumor response, and decrease relapse due to escape of subpopulations that have lost the CAR T cell target antigen. To model incomplete penetrance of a CAR T cell tumor neoantigen, B16-hCD19 and B16-WT tumors are implanted at a 1:1 ratio into the flanks of mice, as demonstrated in the study shown in FIGS. 10A-10D. This represents a solid tumor in which half of the cells may be targeted by CAR T cells, with the remaining portion requiring an endogenous immune response for clearance, as has been described in human tumors (Hegde M, et al. Mol Ther. 2013; 21(11):2087-101). Tumors and T cells are implanted and administered, and tumor growth/survival is determined. Endogenous T cell frequency, activation, and functionality are determined and TCR sequencing is used to assess effects on the endogenous T cell repertoire. To confirm whether optimal response requires an endogenous T cell repertoire, the same mixed tumors are implanted in Rag1−/− mice, where injection of any 19BBz synNotch T cell should lead to loss of B16-hCD19 cells but persistence of the B16-WT subpopulation.

Determine Efficacy of RNA DAMP CAR T Cell Therapy Combined with Immune Checkpoint Blockade Although the delivery of an RNA DAMP by CAR T cells may enhance endogenous tumor-reactive T cells, these T cells are susceptible to additional resistance mechanisms involving the upregulation of inhibitory ligands (Joshi N S, et al. Immunity. 2015; 43(3):579-90). In addition, CAR T cells may also be vulnerable to similar adaptive resistance mechanisms involving immune checkpoints. To examine this, mice are implanted with mixed tumors and treated with 19BBz synNotch T cells, but additionally receive three doses of anti-PD1 or anti-CTLA4. Mice are then monitored for tumor growth and survival, and one cohort is sacrificed to measure activation status of both CAR T cells and endogenous T cells. Controls include mice treated with 19BBz synNotch T cells alone. In addition, 19BBz GFP synNotch T cells that do not deliver stimulatory RNA are also examined with or without ICB. This measures direct effect of ICB on CAR T cells alone and allows for better assessment of the effects attributable to endogenous T cell activation. These experiments are repeated with a second, immunologically "cold" cancer model (e.g. PDA152).

Example 3: RN7SL1 Activates T Cells and Antigen Presenting Cells

This example shows that RN7SL1 can favorably activate T cells and critical antigen presenting cells (e.g., CD103+ dendritic cells) to promote immune responses.

Figure 14A:
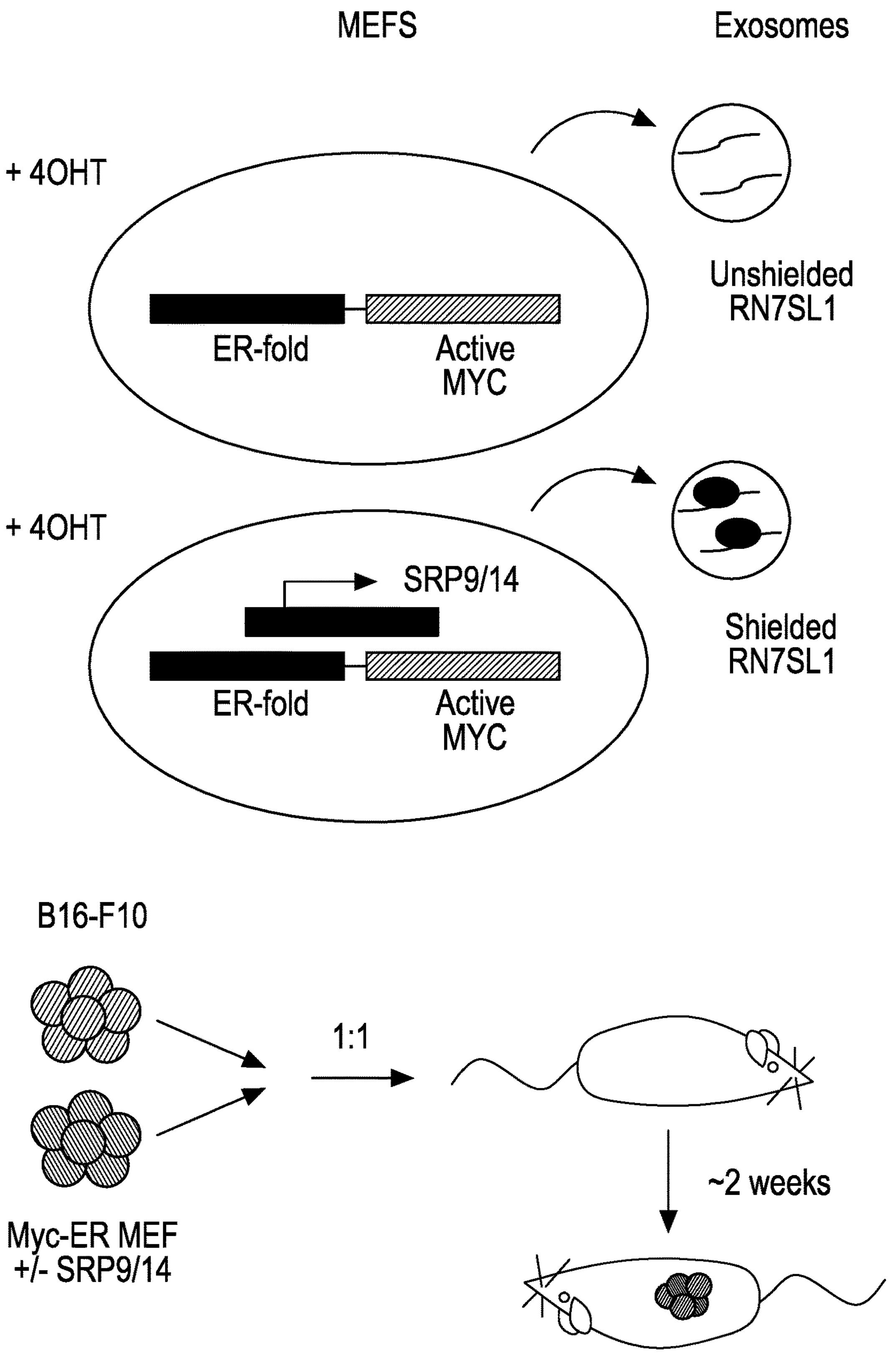
FIGS. 14A, 14B, 14C, and 14D: Unshielded RN7SL1 in the tumor microenvironment (TME) enhances DCs and T cell activation.
Figure 14B:
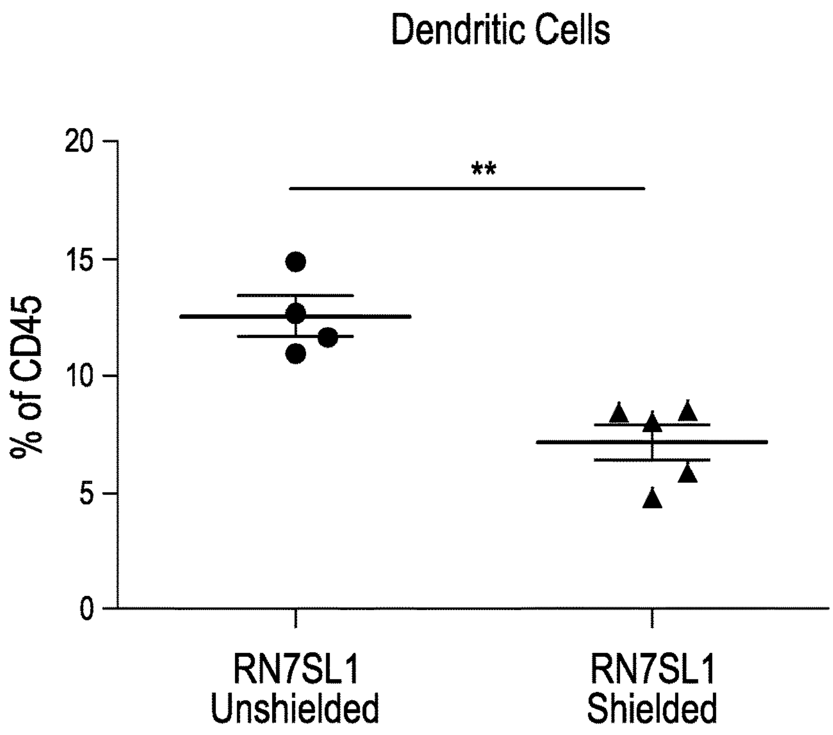
Figure 14C:
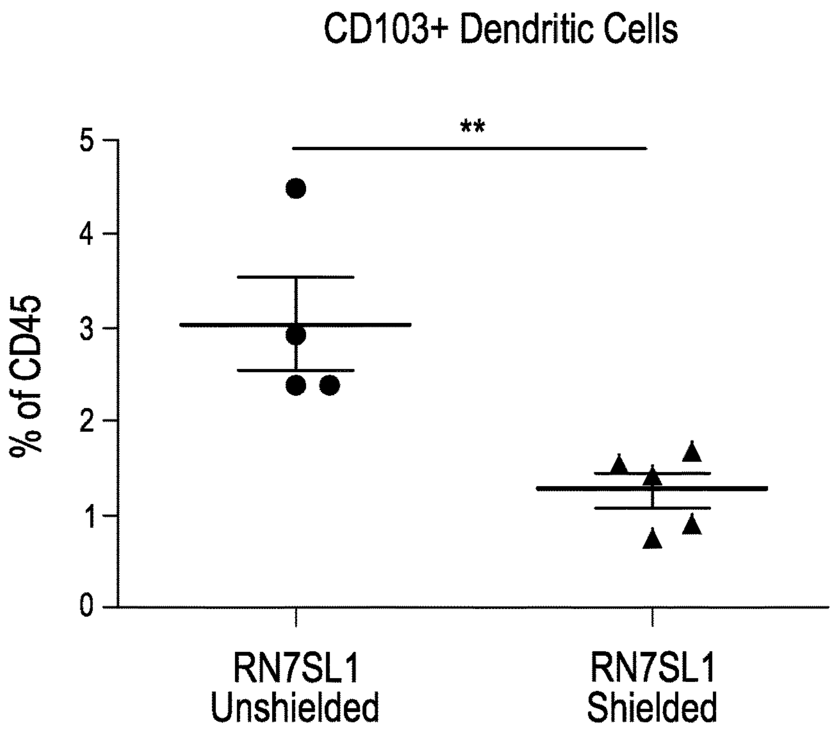
Figure 14D:
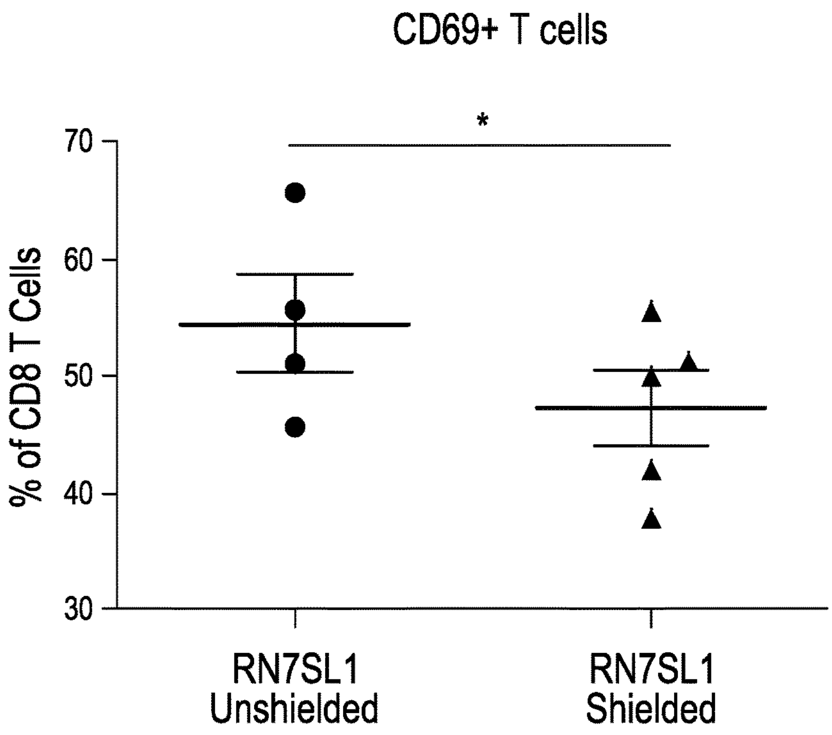
Figure 14E:
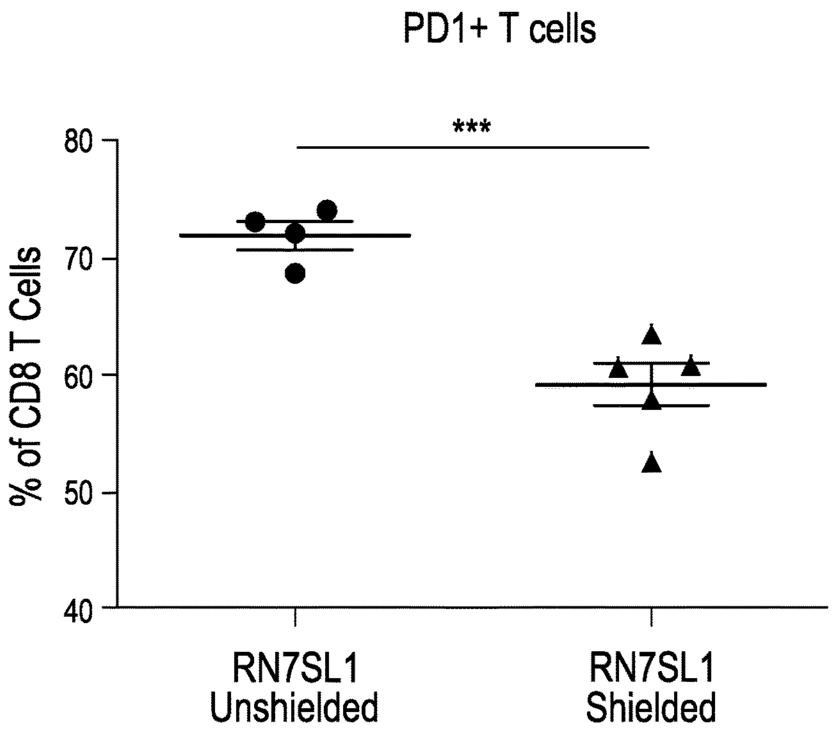
Figure 15A:
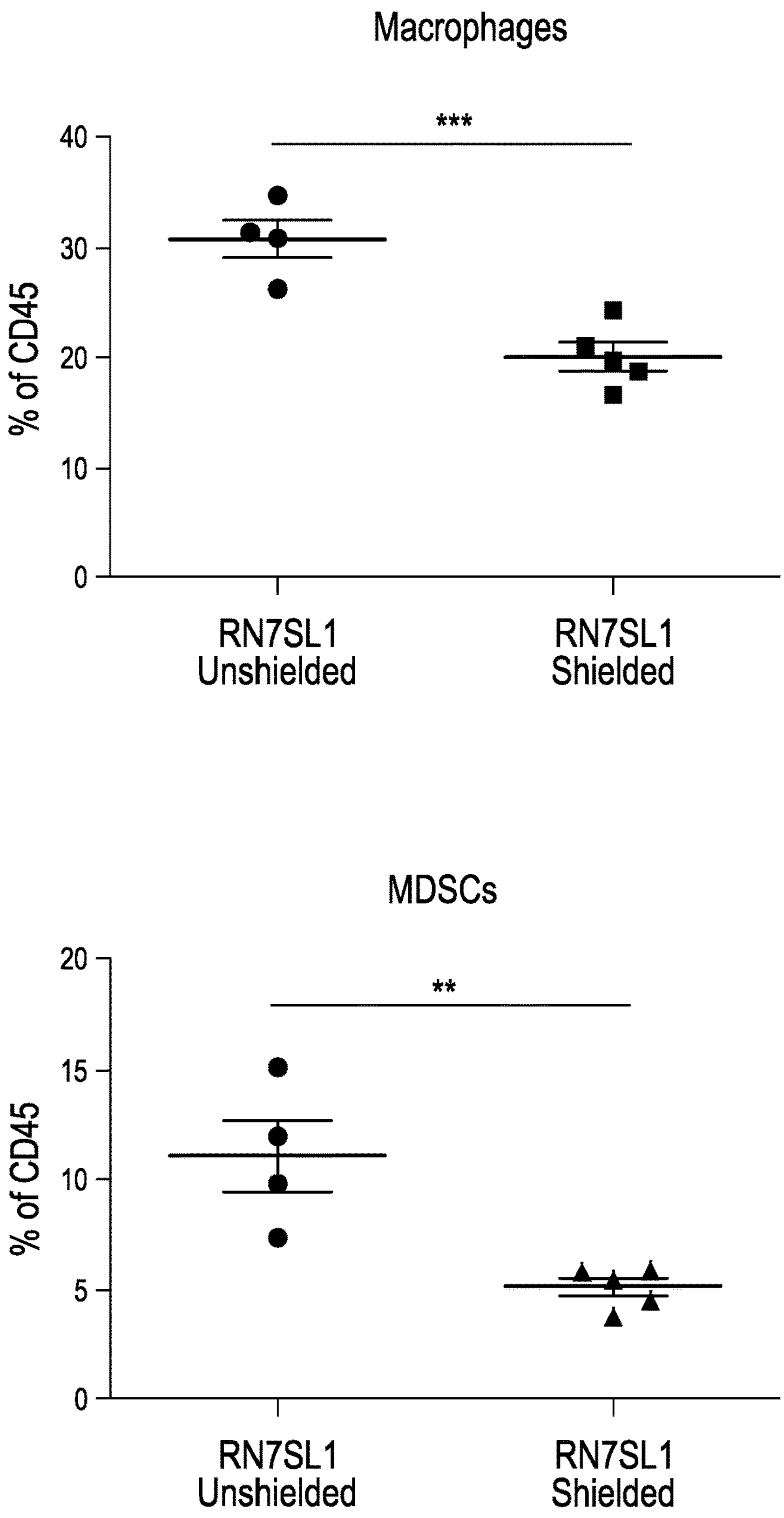
FIGS. 15A and 15B: Unshielded RN7SL1 in the TME increases tumor-associated macrophages (TAMs) as well as myeloid-derived suppressor cells (MDSCs).
Figure 15B:
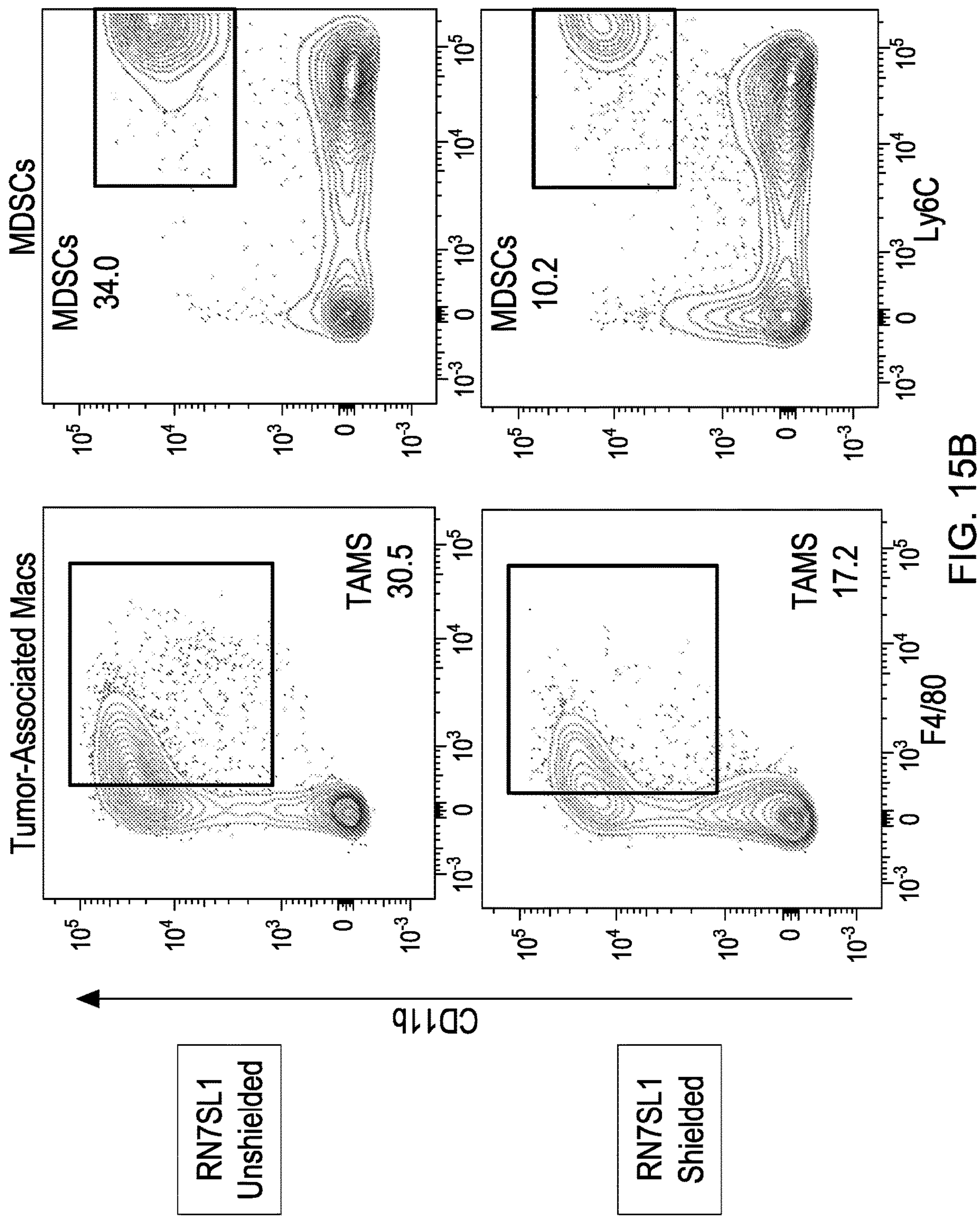
Figure 16A:
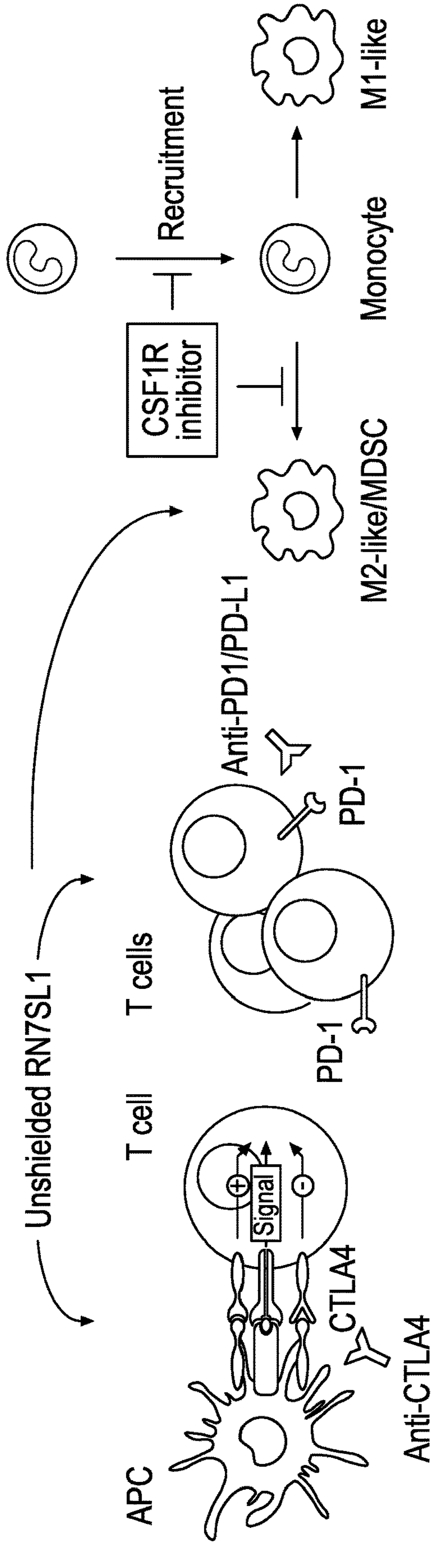
FIGS. 16A, 16B, and 16C: Inhibition of M2 polarization reveals immunostimulatory effect of unshielded RN7SL1.
Figure 16B:
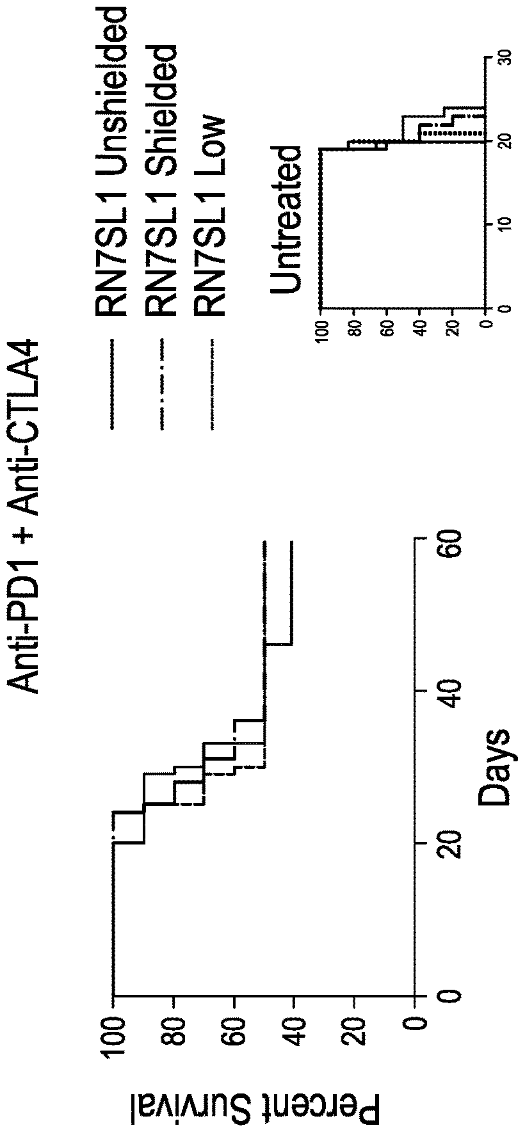
Figure 16C:
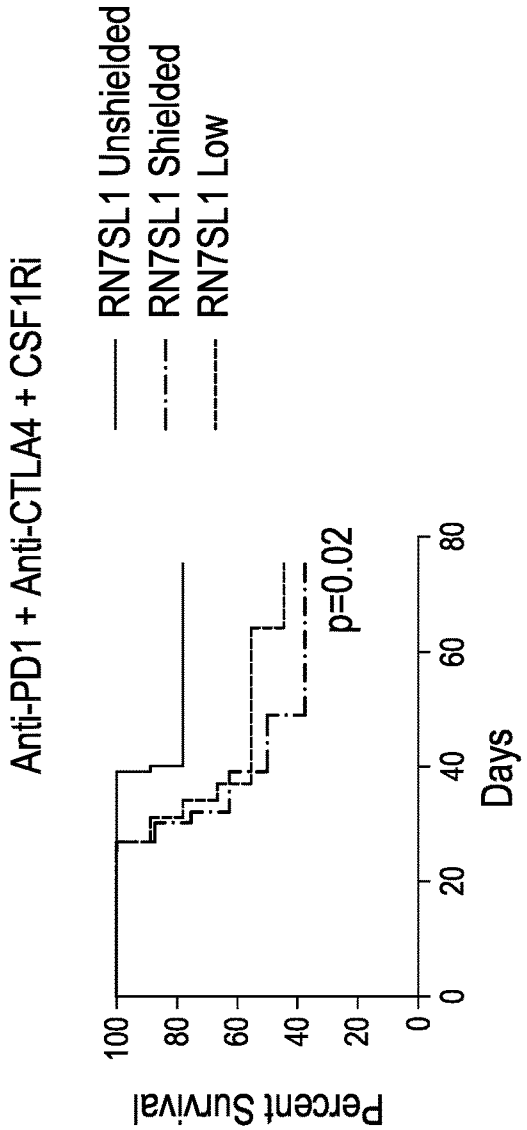

Mice were implanted with B16-F10 tumor cells mixed 1:1 with MEFs or MEFs co-expressing SRP9/14 (FIG. 14A). Tumor was harvested 2 weeks post-injection and analyzed for immune cell populations. Unshielded RN7SL1 increased the frequency of dendritic cells (FIG. 14B), the percentage of CD103+ dendritic cells (FIG. 14C), the percentage of CD69+ CD8+ T cells (FIG. 14D), and the percentage of PD1+ CD8+ T cells (FIG. 14E) in tumor. The percentages of macrophages and MDSCs in CD45+ cells were also increased (FIGS. 15A and 15B). Without wishing to be bound by theory, a CSF1R inhibitor blocks M2 polarization and may synergize with unshielded RN7SL1. As shown in FIGS. 16B and 16C, combining RN7SL1 with the CSF1R inhibitor BLZ945 enhanced the anti-tumor activity of an anti-PD1 antibody and an anti-CTLA-4 antibody.

Example 4: 7SL RNA is Stimulatory to Human DCs

Figure 17B:
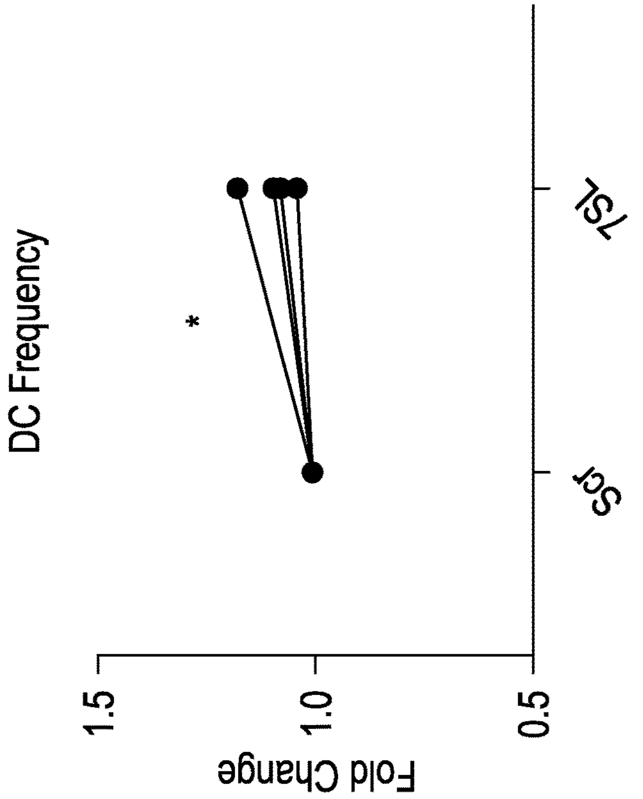
FIGS. 17A, 17B, 17C, and 17D: 7SL RNA is stimulatory to human DCs. In vitro transcribed RNA was isolated and transfected into healthy donor human PBMCs using lipofectamine DCs were assessed by flow cytometry 48 hours later. DCs were gated as Dump-, CD14-, CD200-, CD11c+, HLA-DR+ cells.
Figure 17A:
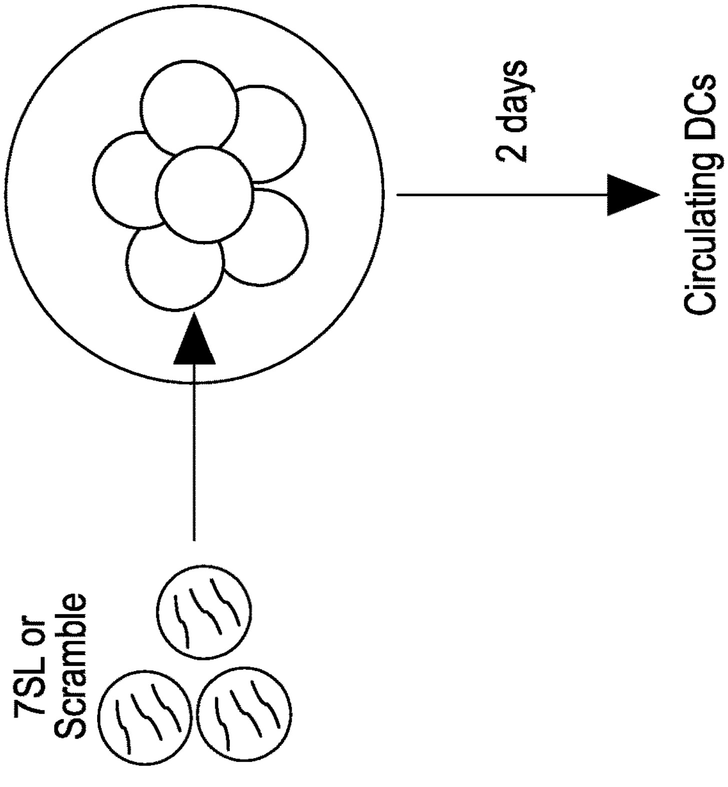
Figure 17C:
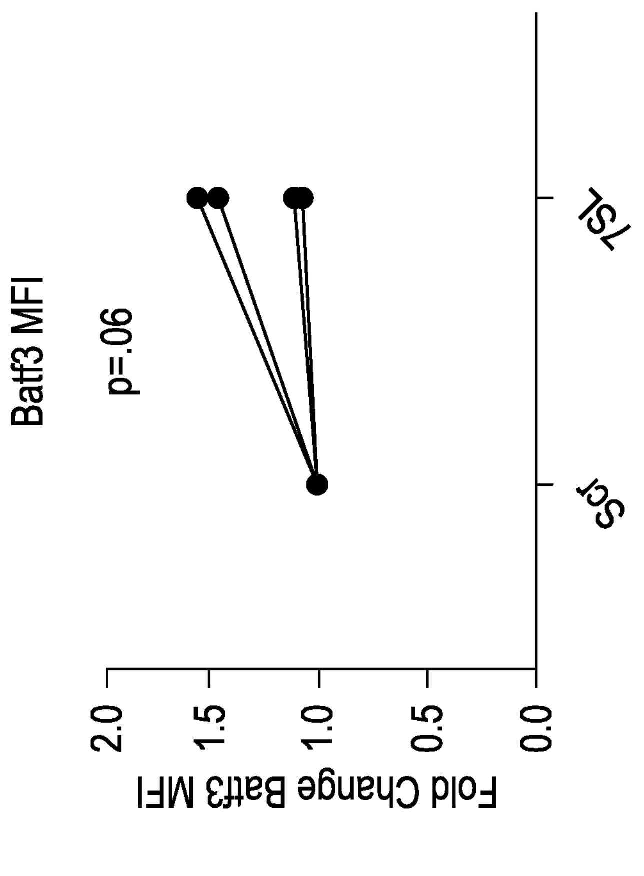
Figure 17D:
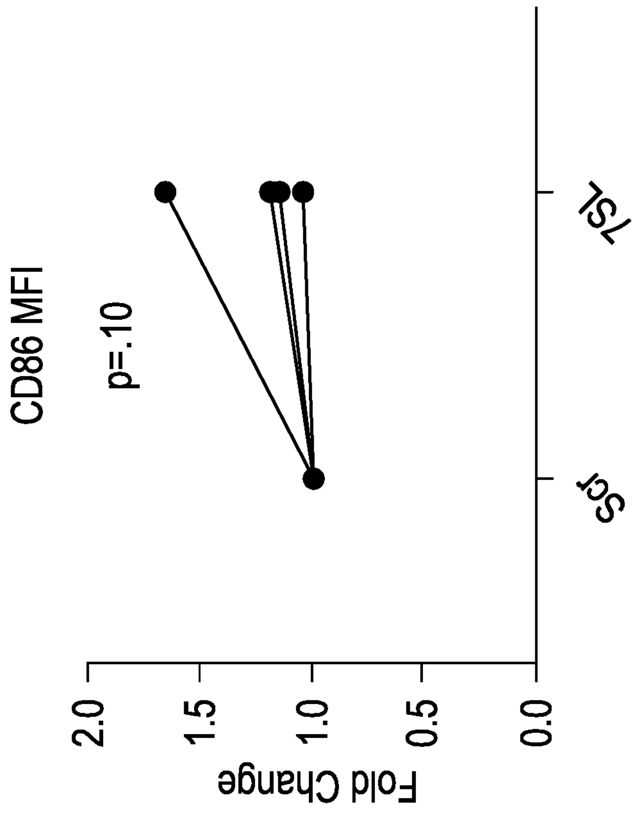
Figure 18A:
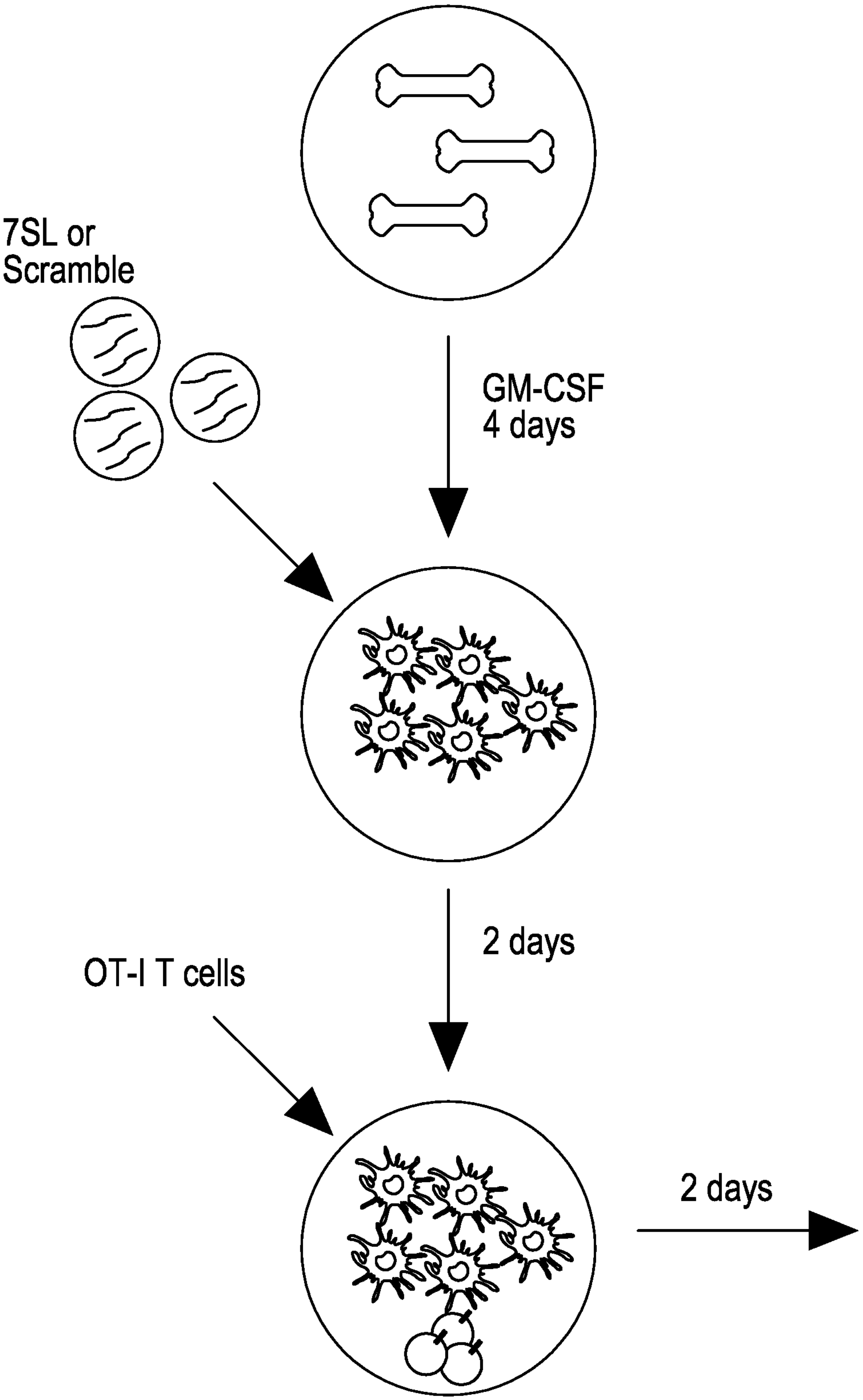
FIGS. 18A, 18B, 18C, 18D, 18E, 18F, and 18G: Murine BMDCs stimulated with 7SL RNA elicit enhanced T cell responses.
Figure 18B:
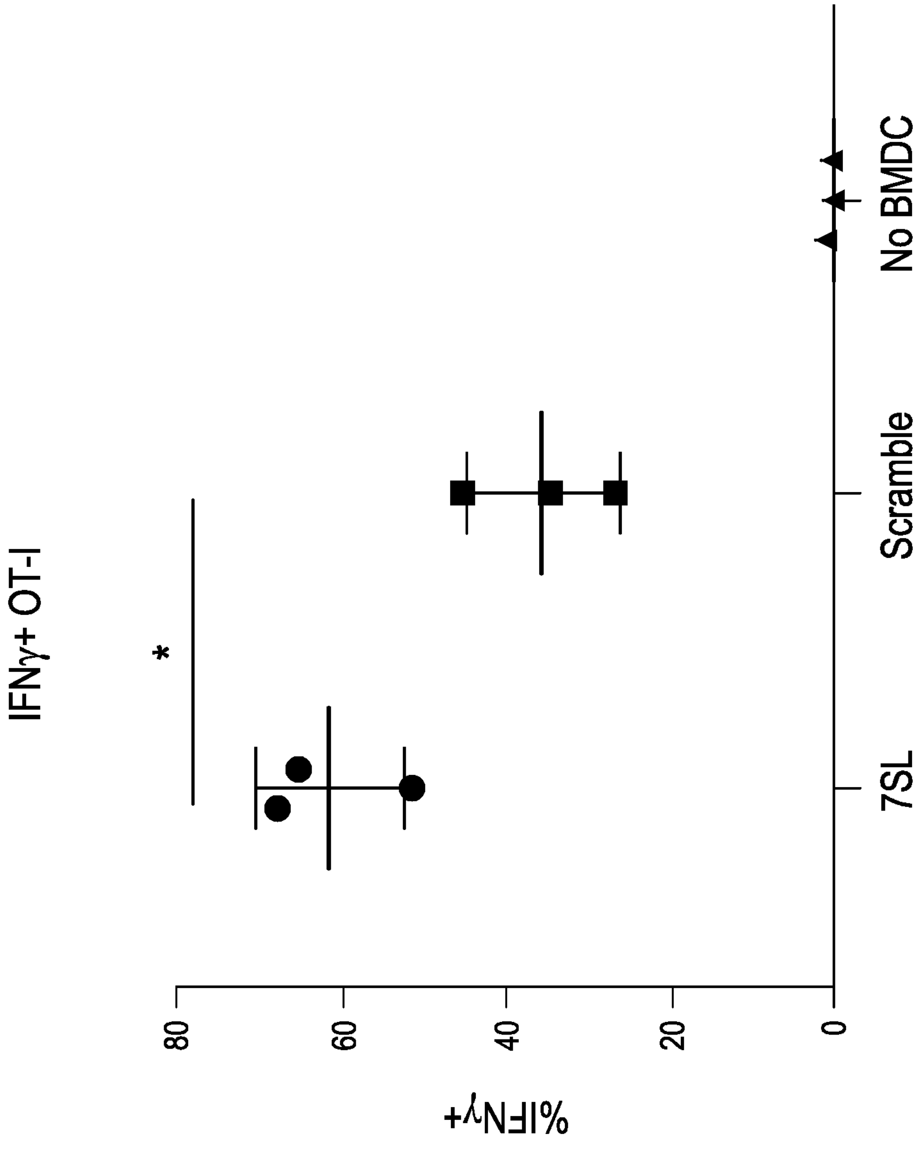
Figure 18C:
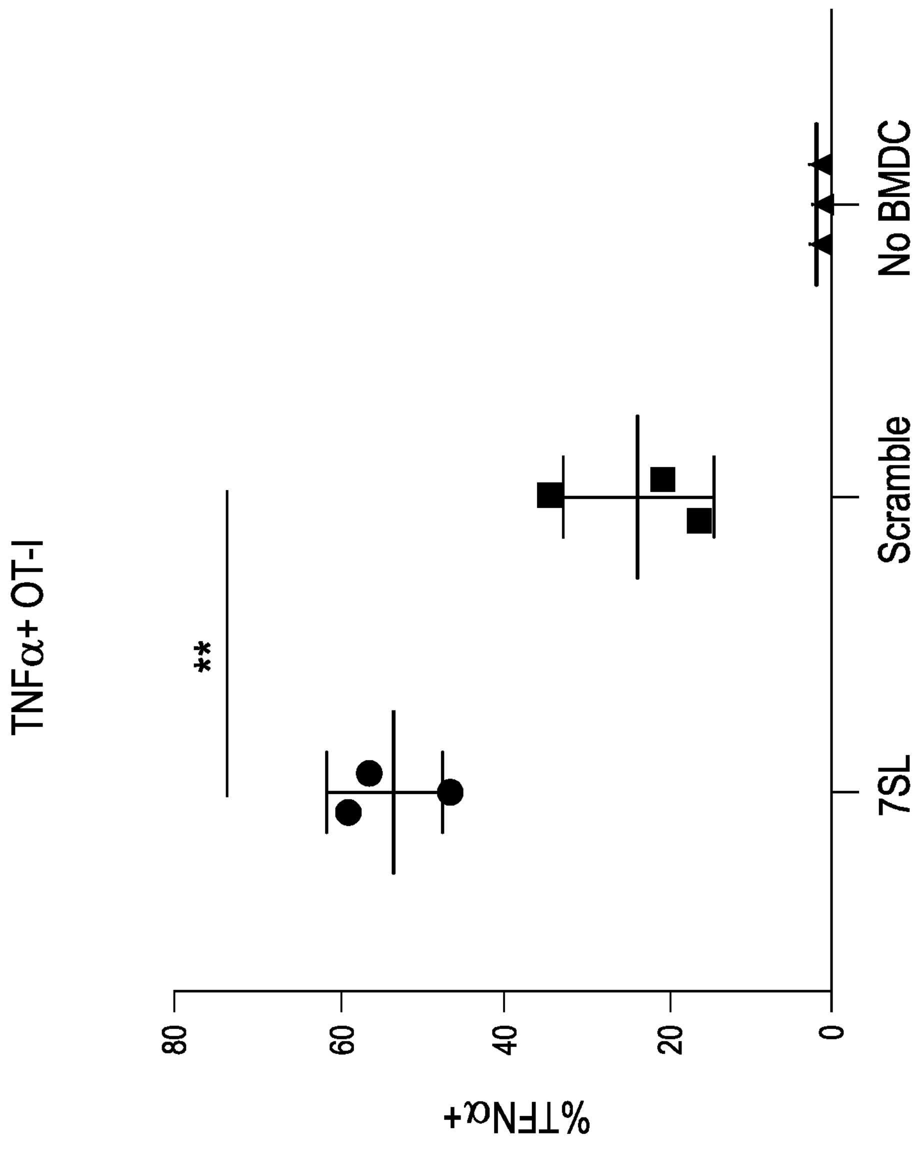
Figure 18D:
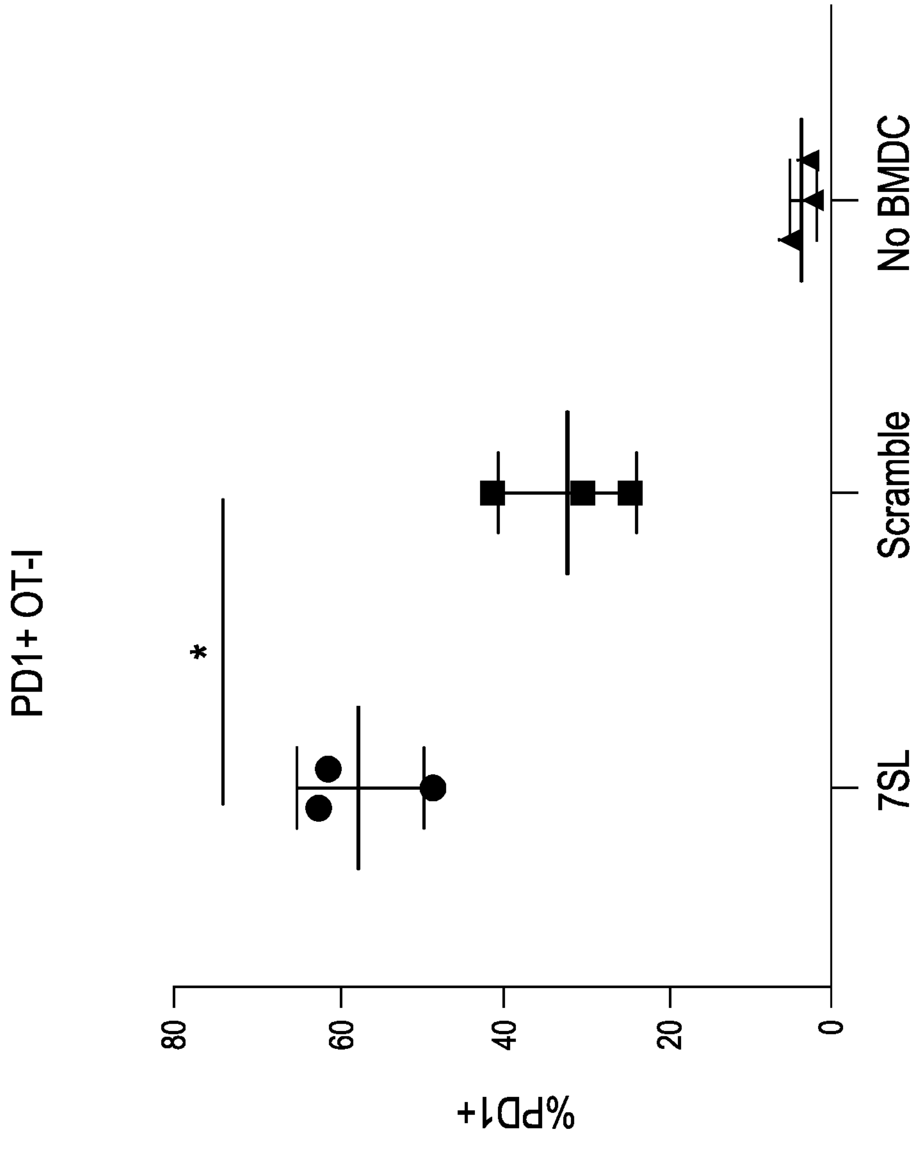
Figures 18E, 18F, 18G:
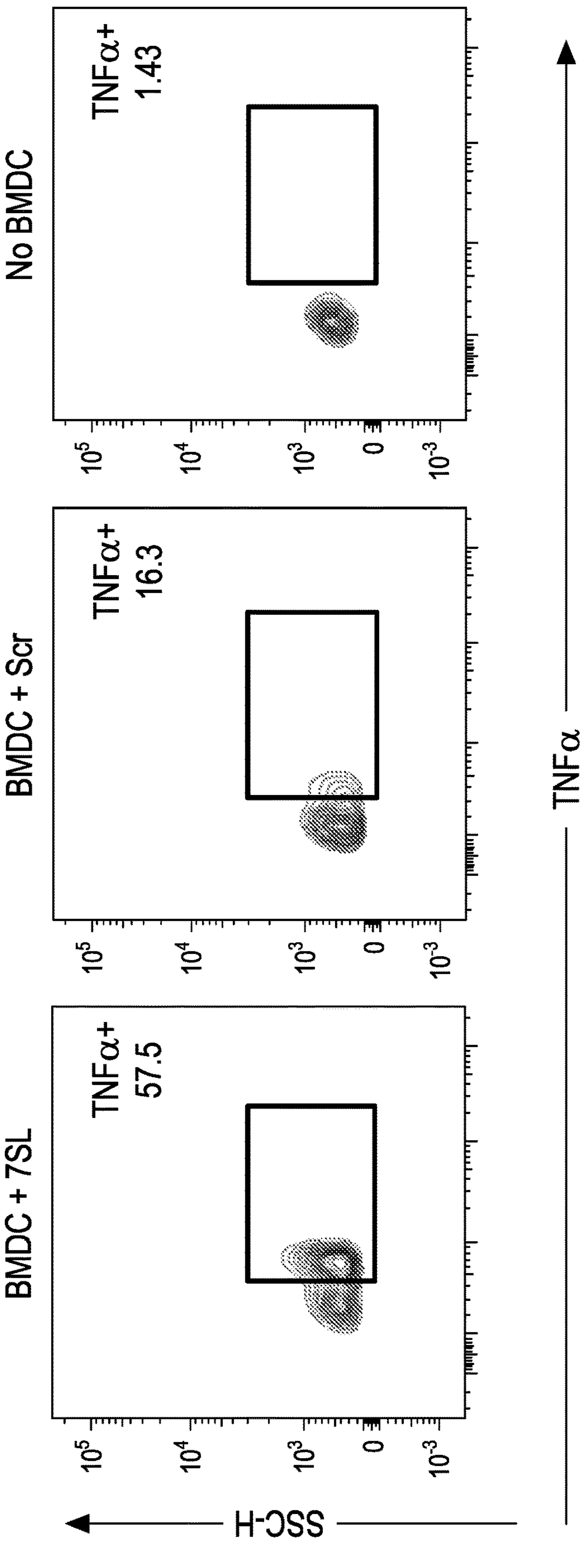

7SL is an immunogenic RNA recognized by human DCs. $1.5\times10^6$ healthy donor PBMCs were plated in triplicate. Data points represent mean of technical replicates, 5 individual donors. 200 ng of 7SL or Scramble (Scr) in vitro transcribed RNA was encapsulated in liposomes and transfected into the PBMCs. Cultures were harvested 48 hours later. This data demonstrates the immunogenic nature of 7SL RNA as compared to a scramble control (FIGS. 17B-17D); furthermore, in unshown data, scramble RNA (which also contains a 5' triphosphate) is also stimulatory when compared to empty liposome controls. This implies that both the 5' triphosphate motif and structured nature of 7SL has stimulatory capacity to human DCs, which are an important initiator of anti-tumor immunity.

Example 5: Murine BMDCs Stimulated with 7SL RNA Elicit Enhanced T Cell Responses DCs function to initiate anti-tumor immunity by priming CD8+ T cell responses. The capability of 7SL-stimulated DCs to perform this function was tested using the murine transgenic OT-I system. Bone marrow derived dendritic cells (BMDCs) were obtained by culturing $5\times10^6$ cells from bone marrow in 40 ng/mL of GM-CSF for 6 days. 200 ng of RNA was transfected into developing BMDCs at day 4. At day 6, BMDCs were collected, washed, loaded with Ova peptide, and washed again. Cells were then plated at a 1:3 ratio with purified OT-I CD8+ T cells. 48 hours later T cells were stained for cytokine production and activation markers. 7SL-stimulated BMDCs are significantly better at stimulating T cell production of IFNγ and TNFα, which correlated with PD1 upregulation (FIGS. 18B-18G).

Figure 19A:
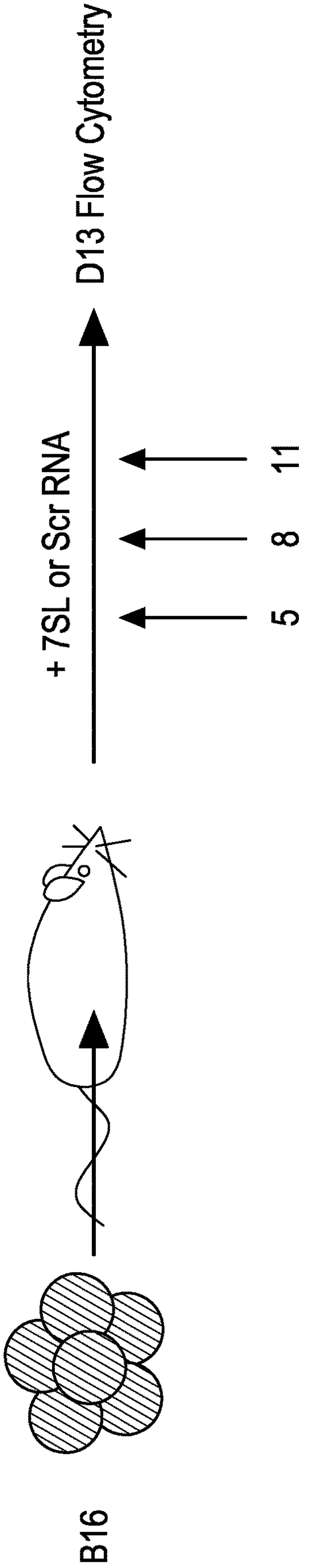
FIGS. 19A, 19B, and 19C: Direct injection of 7SL drives enhanced immune activation in tumors.
Figure 19B:
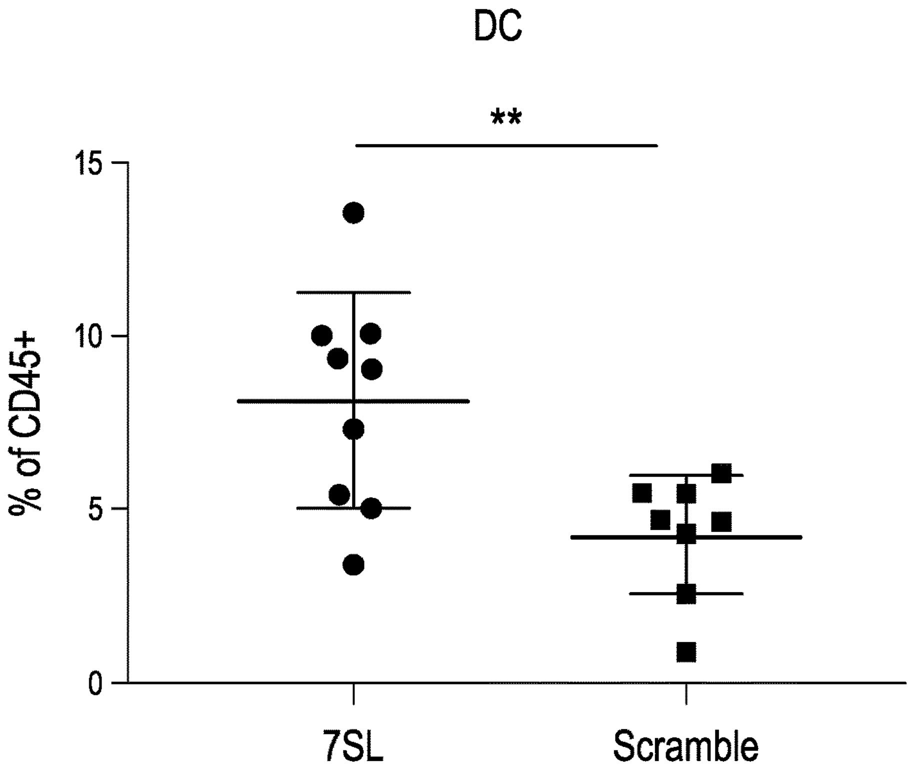
Figure 19C:
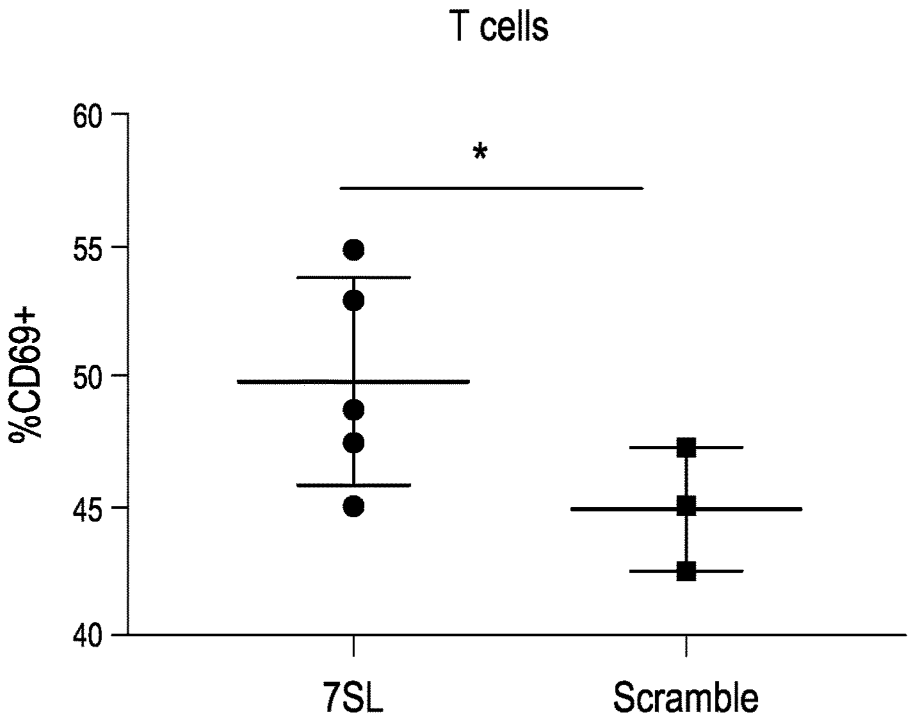

Example 6: Direct Injection of 7SL Drives Enhanced Immune Activation in Tumors In order to investigate whether injection of immunogenic RNA has the potential to influence immune activation in vivo, mice were implanted with B16-F10 tumors in the flank. 200 ng of RNA was then directly injected at the tumor site on day 5, 8, and 11. Tumors were harvested at day 13 and immune infiltrate was assessed by flow cytometry. DC infiltration was significantly increased in tumors injected with 7SL as compared to Scramble RNA controls (FIG. 19B). This correlated with an increase in the frequency of activated T cells as measured by percent of CD69+ cells (FIG. 19C), as well as percent of PD1+ cells (data not shown).

Example 7: Direct Injection of 7SL RNA Improves Response to ICB

Figure 20A:
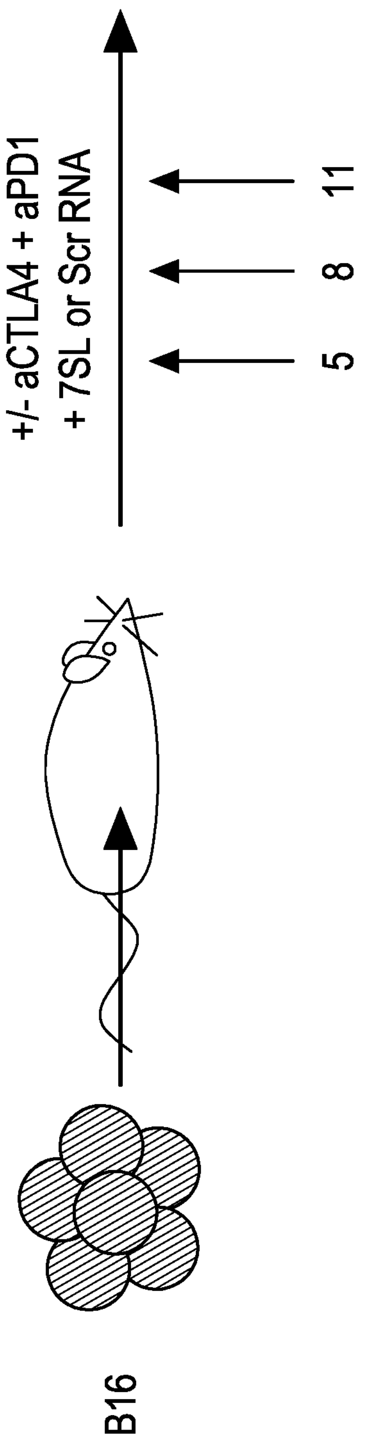
FIGS. 20A, 20B, 20C, and 20D: Direct injection of 7SL RNA improves response to ICB.
Figure 20B:
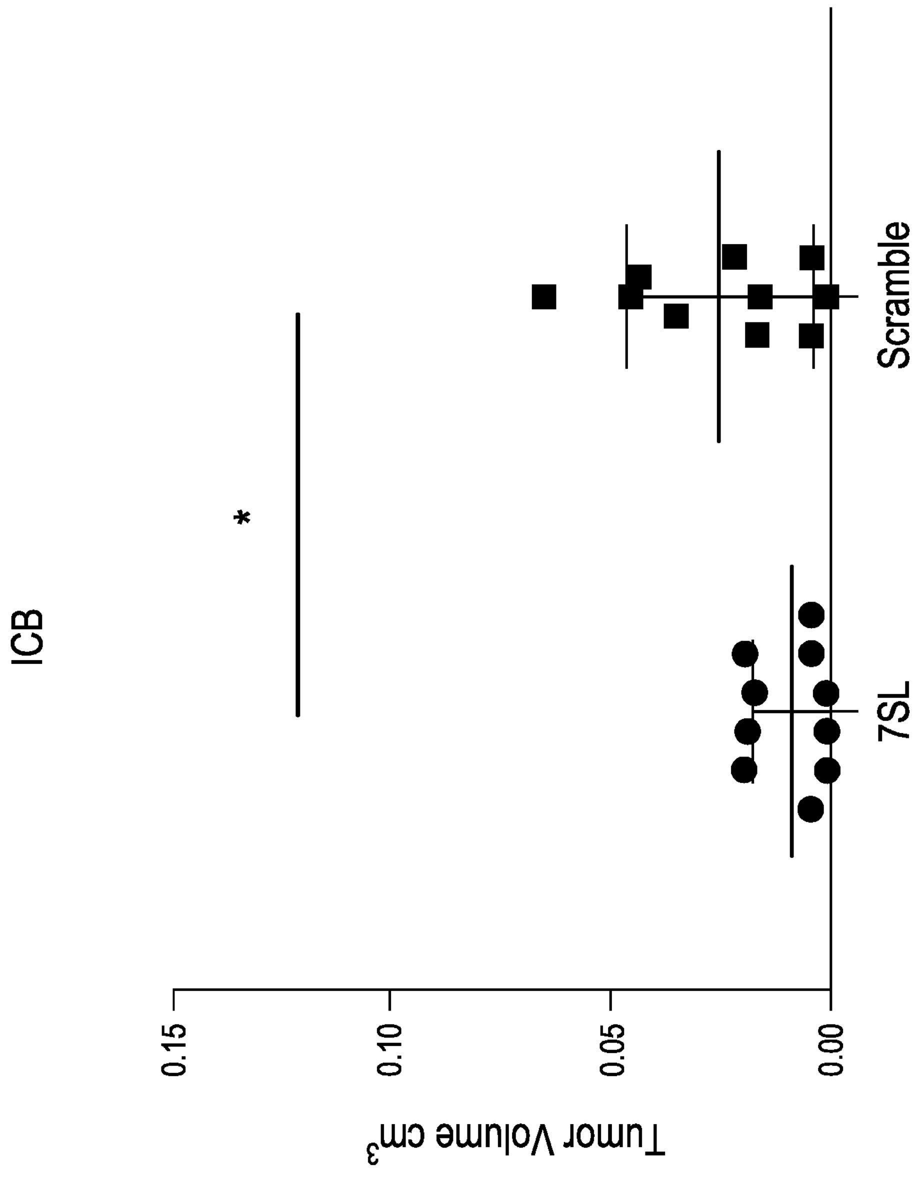
Figure 20C:
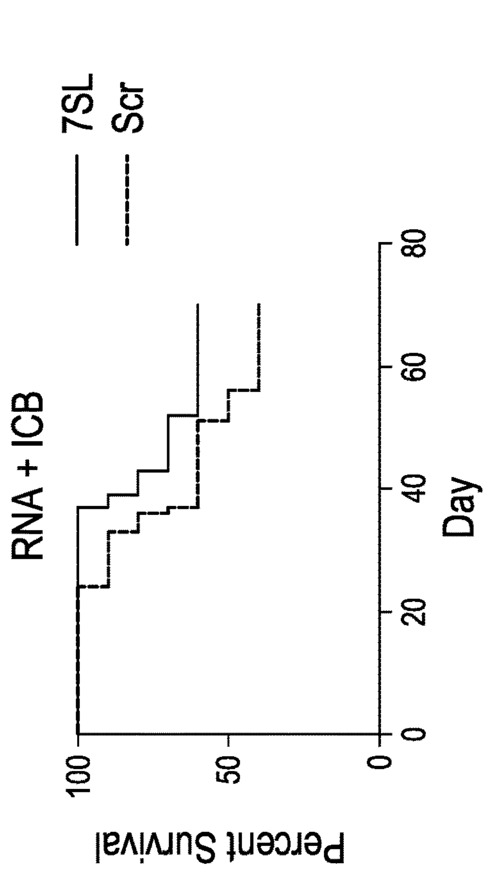
Figure 20D:
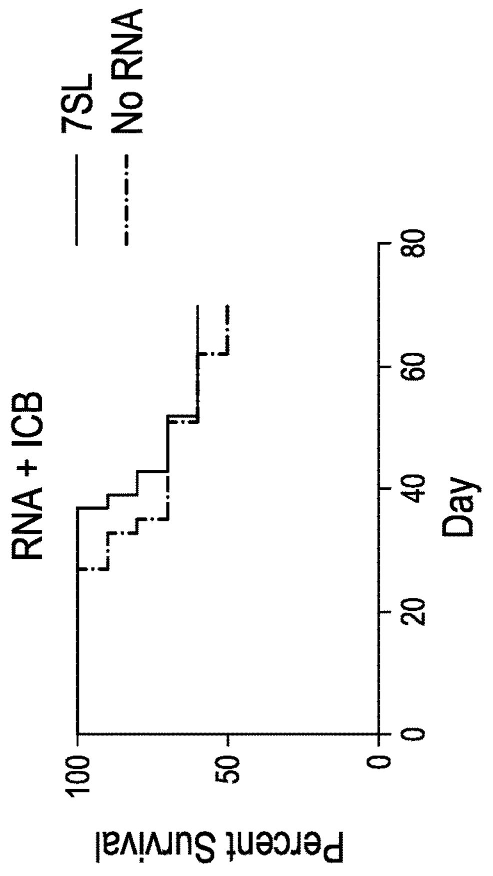

Since 7SL improves immune infiltrate, it was hypothesized that 7SL RNA would synergize with immune checkpoint blockade (ICB). To test this, the same tumor and RNA injection scheme outlined above was performed, and the mice were concurrently treated with blocking antibodies to PD1 (RMP1-14) and CTLA4 (9H10). Injection with 7SL RNA significantly limited early tumor growth in comparison to scramble RNA (FIG. 20B) and improved overall survival as compared to scramble RNA (FIG. 20C) and empty liposome controls (FIG. 20D).

Figure 21A:
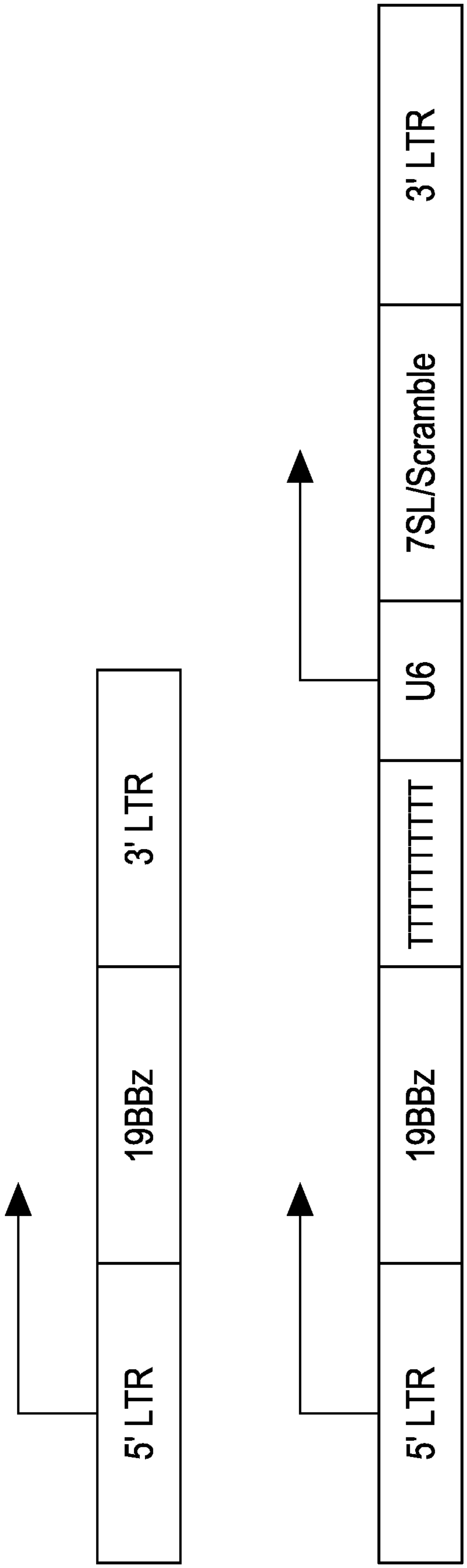
FIGS. 21A, 21B, 21C, 21D, and 21E: 19BBz-7SL CAR T cells control tumors more robustly than parental or control CAR T cells. Mice were implanted with B19-h19 tumors and given mCAR T cells expressing h19BBz on Day 5 and Day 12 i.v. Anti-CTLA4 was administered where indicated on Day 8, Day 11, and Day 14. N=2 experiments combined.
Figure 21B:
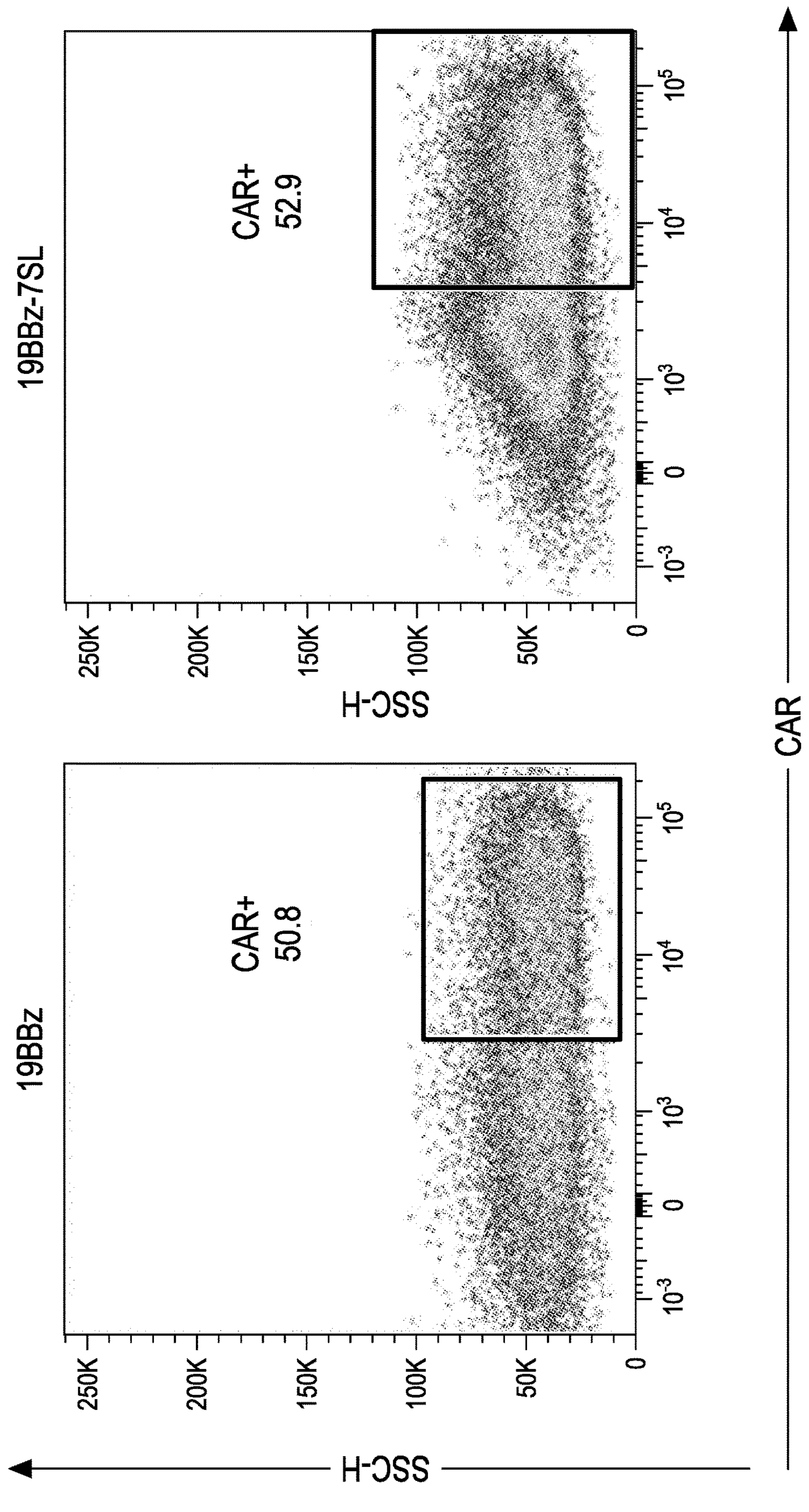
Figure 21C:
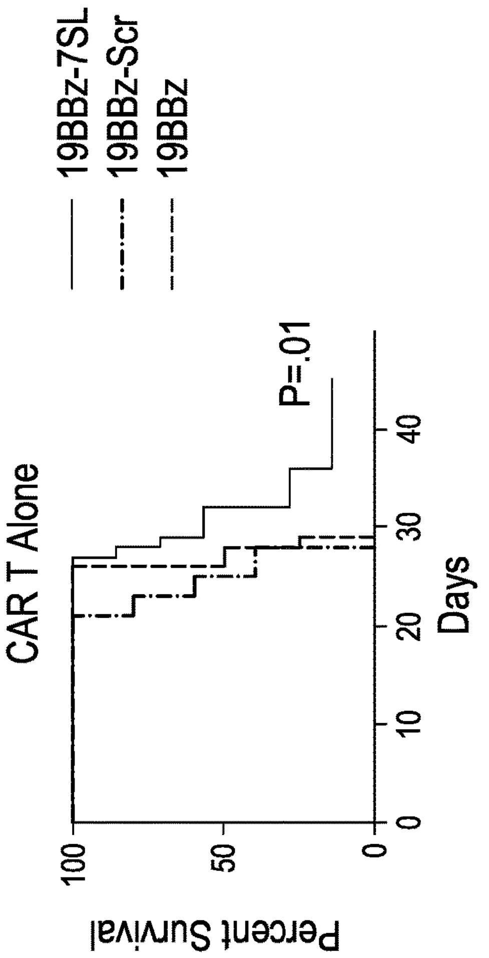
Figure 21D:
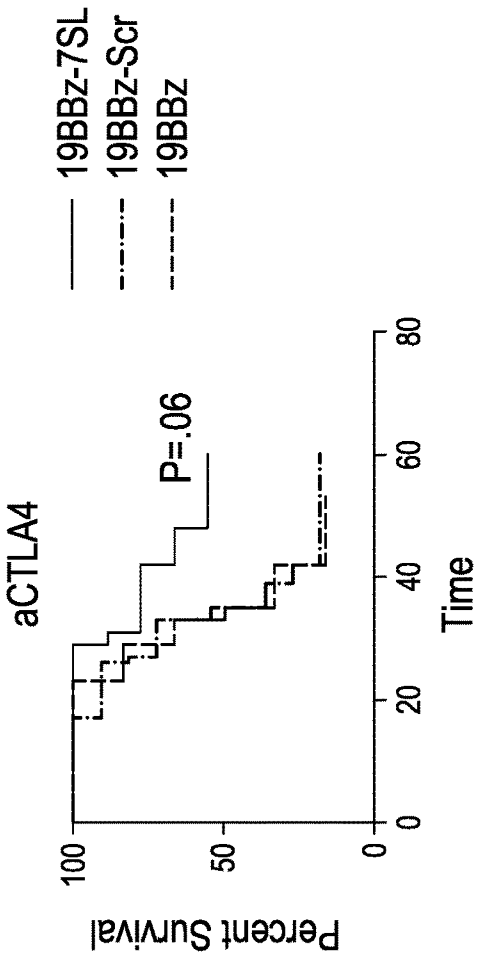
Figure 21E:
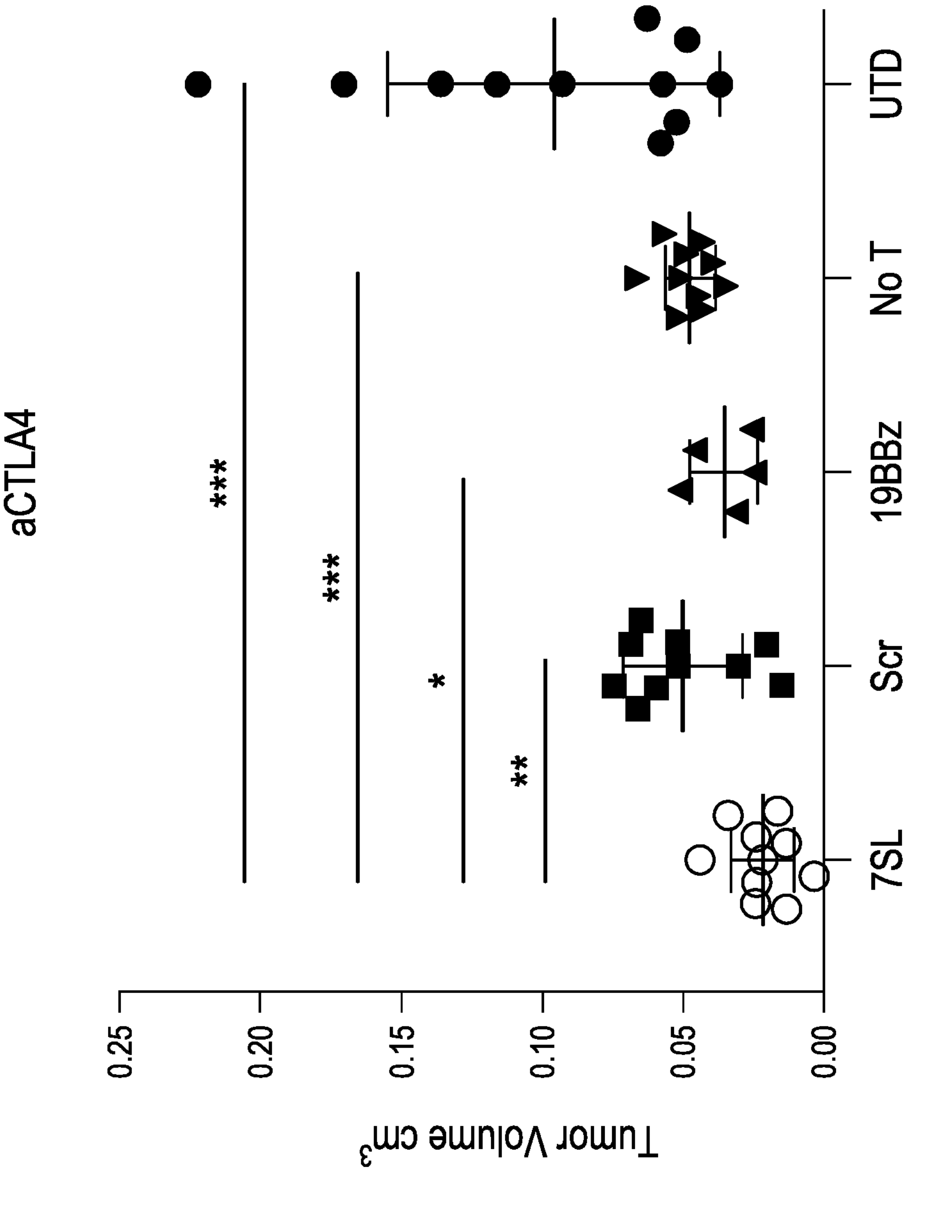

Example 8: 19BBz-7SL CAR T Cells Control Tumors More Robustly than Parental or Control CAR T Cells In order to deliver 7SL RNA in a focused manner to the tumor microenvironment, CAR T cells capable of producing an RNA Pol-III transcribed 7SL molecule were designed in order to preserve the 5' triphosphate nature of the endogenous RNA. Briefly, the system consists of the standard 19BBz CAR molecule followed by a Poly-T transcriptional stop signal, which is then followed by a human U6 RNA-Pol-III promoter that drives transcription of the 7SL RNA (see SEQ ID NO: 849 in Table 1) or scramble control RNA (see SEQ ID NO: 850 in Table 1). This setup is outlined in FIG. 21A, and comparable CAR expression is shown in FIG. 21B. Mice were implanted with B16-F10 tumors engineered to express the human CD19 antigen (B16-h19) and treated with indicated murine CAR T cells at Day 5 and Day 12. The anti-CTLA-4 antibody was administered on Day 8, Day 11, and Day 14. 7SL-CAR T cells showed improved tumor control (FIG. 21E) and survival rates as a single therapy (FIG. 21C) and when used in combination with a CTLA4 blocking antibody (FIG. 21D).

Example 9: 19BBz-7SL CAR T Cells Alter Endogenous Immune Activation

Figure 22A:
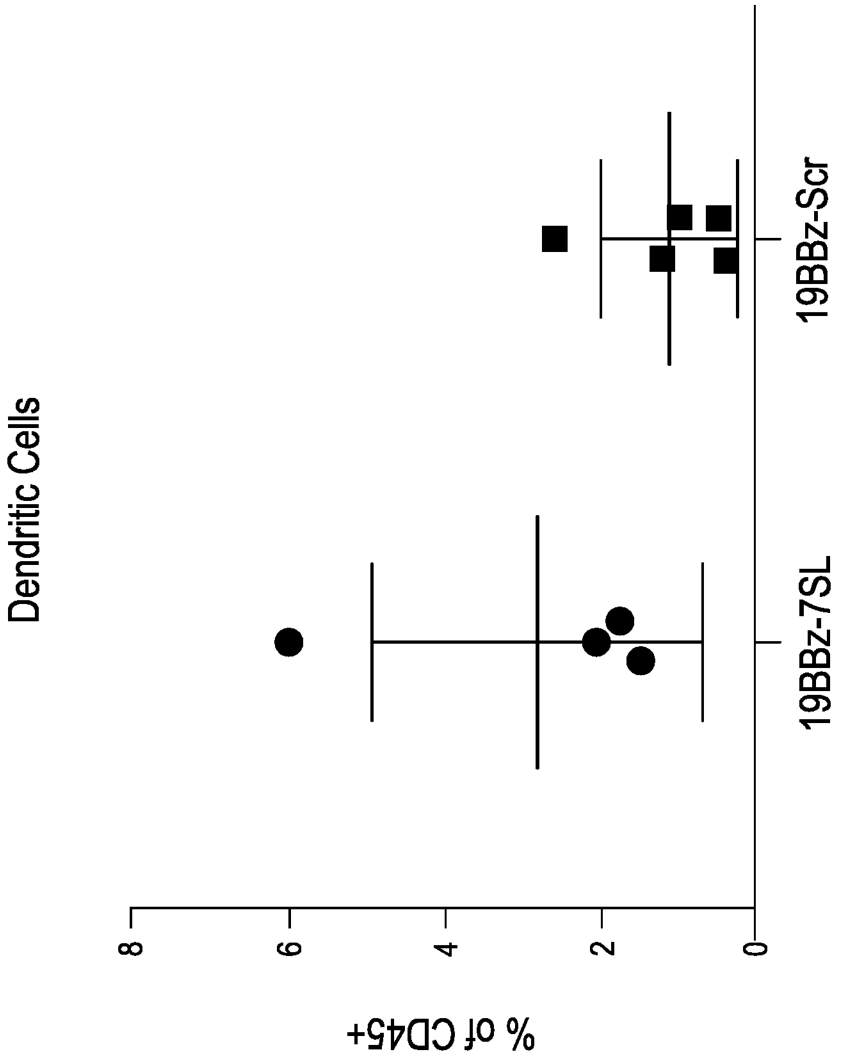
FIGS. 22A, 22B, and 22C: 19BBz-7SL CAR T cells alter endogenous immune activation. Mice were implanted with B19-h19 tumors and given 19BBz-7SL or 19BBz-Scr mCAR T cells on Day 5 and Day 12 i.v. Tumors were harvested at Day 15.
Figure 22B:
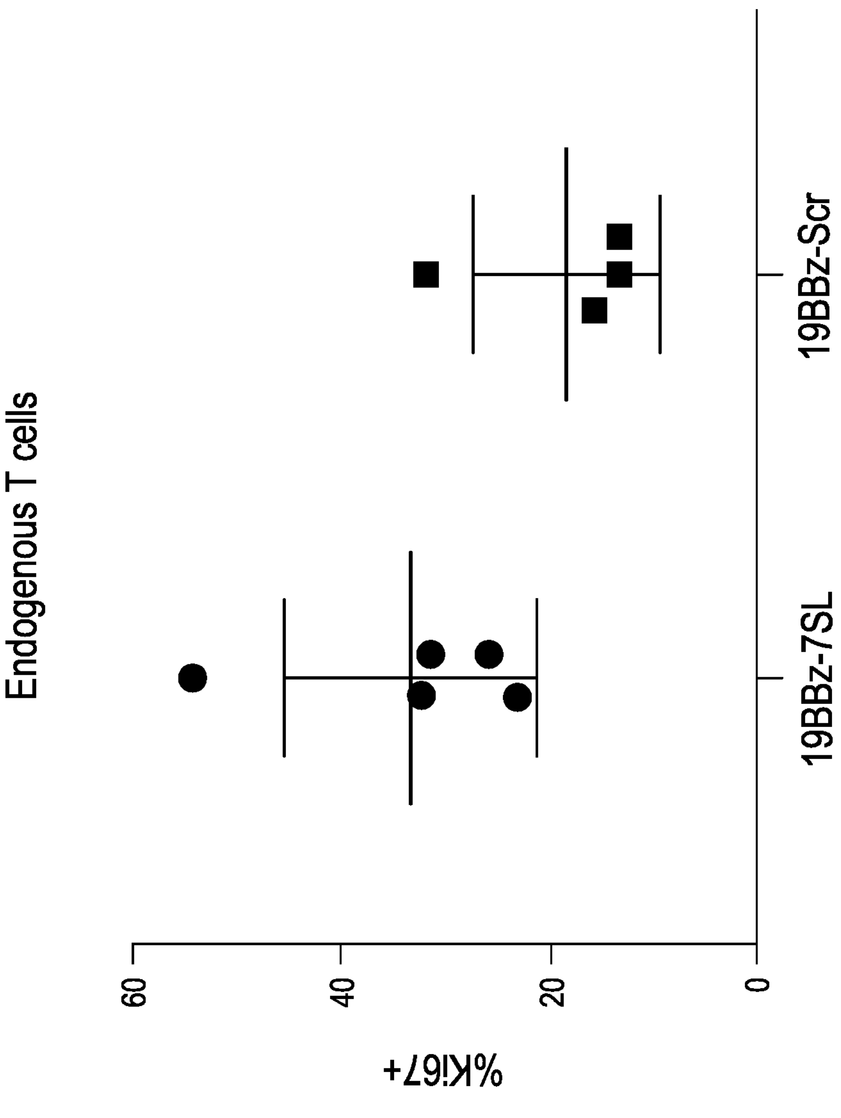
Figure 22C:
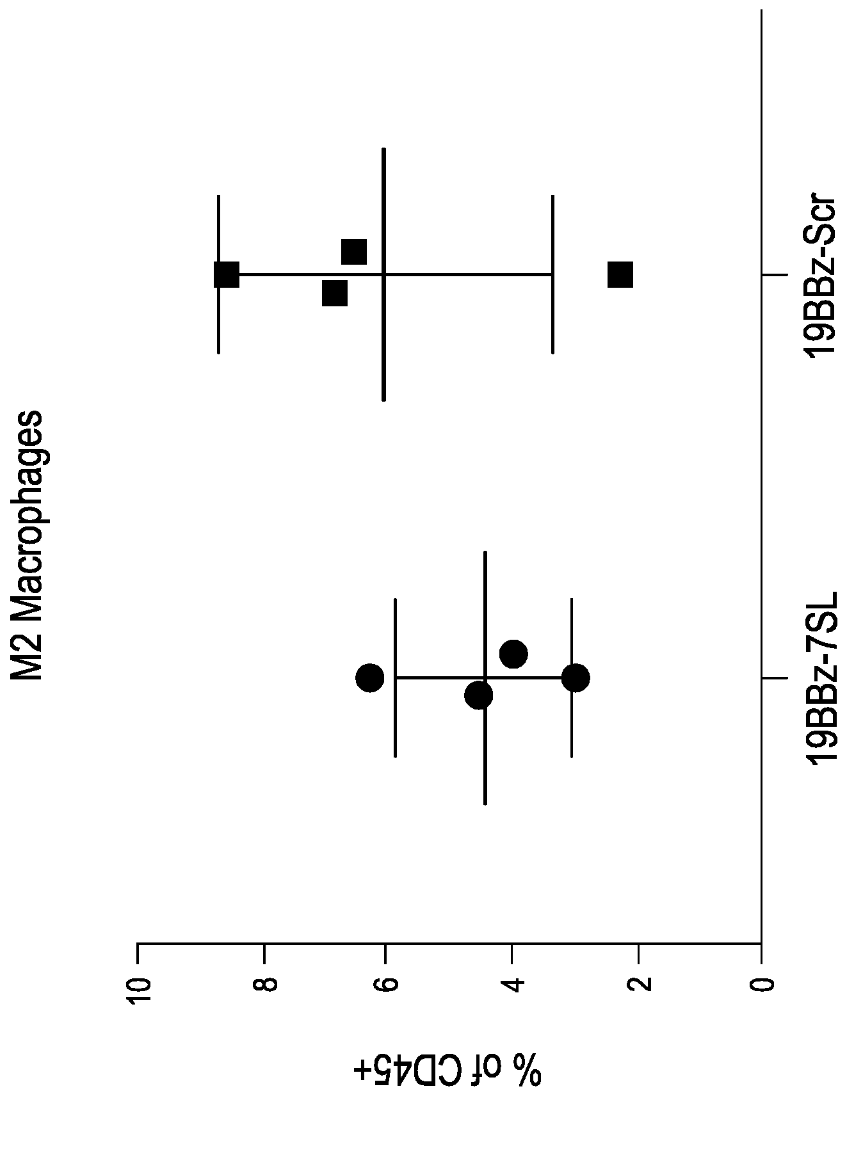

Preliminary analysis of endogenous immune infiltrate from tumors treated with 7SL-CAR T cells demonstrates potentially enhanced recruitment of DCs (FIG. 22A) and activation of endogenous T cells (FIG. 22B), similar to results obtained by direct injection with RNA. Furthermore, M2 polarization of macrophages was not increased in response to enhanced presence of 7SL RNA produced by engineered T cells (FIG. 22C).

Example 10: Anti-CTLA4 Antibody Benefit is Dependent on Endogenous T Cells

Figure 23:
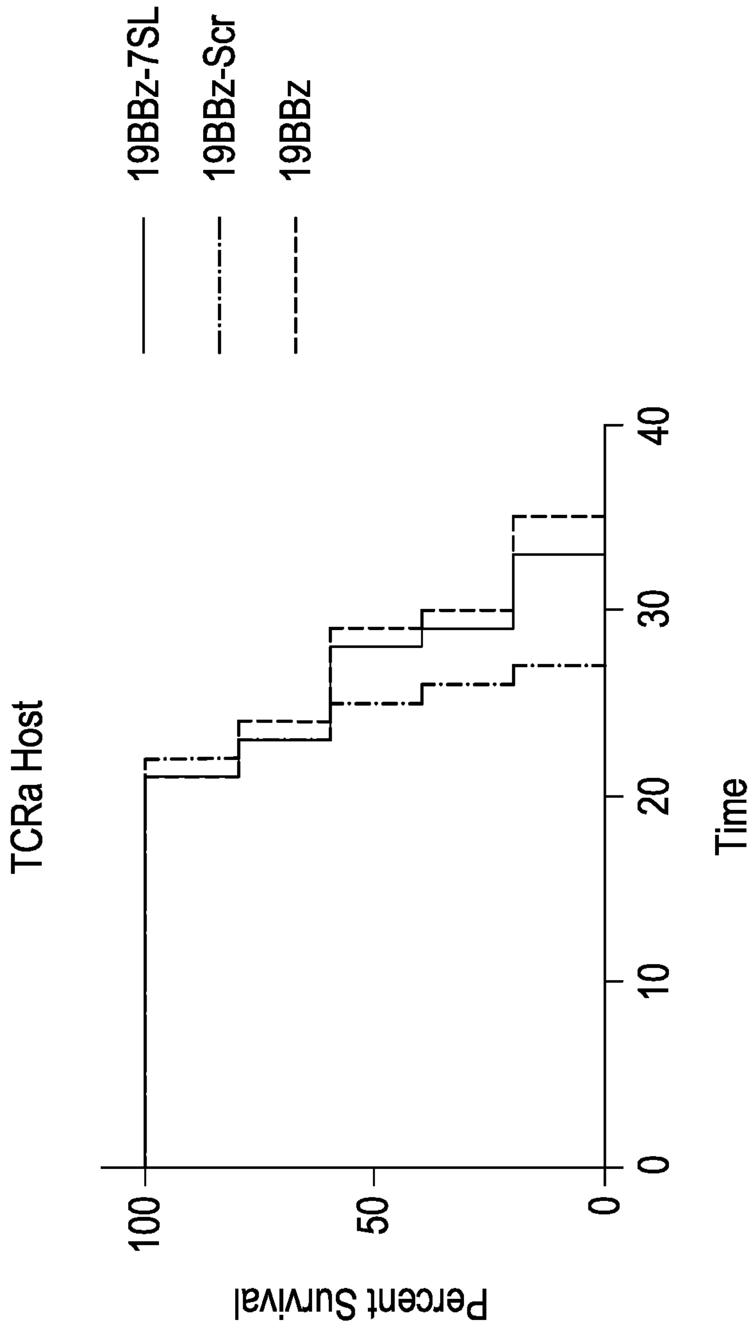
FIG. 23 is a graph showing percent survival of mice treated with 19BBz-7SL+anti-CTLA4, 19BBz-Scr+anti-CTLA-4, and the 19BBz+anti-CTLA4 in TCRa knockout mice lacking endogenous T cells.

There are two potential mechanisms underlying improved responses seen in 7SL-CAR T treated mice. Direct activation of CAR T cells by stimulatory RNA may allow improved cell intrinsic activation of the CAR T cell and therefore improved tumor control, or the RNA may be secreted into the tumor microenvironment and stimulate endogenous immune populations. Enhanced endogenous T cell responses would likely represent a polyclonal population able to target CAR-antigen negative tumor cells and may synergize with currently approved ICB regimens (as suggested above in combination with anti-CTLA4 antibody). In support of this mechanism, when TCRa KO mice (lacking T cells) were implanted with B16-h19 tumors and treated with 7SL-CAR T cells in combination with aCTLA4, 7SL-CAR T cells control tumor growth no better than parental 19BBz CAR T cells (FIG. 23).

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (853 sequences)

SEQ ID NO: 1 - DNA, 299 bp, Homo sapiens
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctct

SEQ ID NO: 2 - RNA, 299 nt, Homo sapiens
gccgggcgcgguggcgcgugccuguagucccagcuacucgggaggcugaggcuggaggaucgcuugaguccaggaguucugggcuguagugcgcuaugccgaucggguguccgcacuaaguucggcaucaauauggugaccucccgggagcgggggaccaccagguugccuaaggaggggugaaccggcccaggucggaaacggagcaggucaaaacucccgugcugaucaguagugggaucgcgccugugaauagccacugcacuccagccugggcaacauagcgagaccccgucucu

SEQ ID NO: 3 - DNA, 70 bp, Homo sapiens
gccgggcgcggtggcgcgtgcctgtagtcccagctactcgggaggctgaggctggaggatcgcttgagtc

SEQ ID NO: 4 - RNA, 70 nt, Homo sapiens
gccgggcgcgguggcgcgugccuguagucccagcuacucgggaggcugaggcuggaggaucgcuugaguc

SEQ ID NO: 5 - DNA, 23 bp, Homo sapiens
caacatagcgagaccccgtctct

SEQ ID NO: 6 - RNA, 23 nt, Homo sapiens
caacauagcgagaccccgucucu

SEQ ID NO: 7 - DNA, 499 bp, Artificial Sequence
  source: /note="Description of Artificial Sequence: Synthetic polynucleotide"
gcggccgctctagaactagtggatcccccccccccgctccccaaatgacgtaactgtccctgcagcttctagatagcttttcgcagcgtctccgaccggccgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagacgtctcaaatcccctcaaaaaaaaaaaaaaaaaaaaaaaaaaaaaaaaaaaaaaaaaaaacatgggactcaaagtttcagcatcgcgtctcttttgccgaattcgatatcaagcttatcgatacc

SEQ ID NO: 8 - RNA, 499 nt, Artificial Sequence
  source: /note="Description of Artificial Sequence: Synthetic polynucleotide"
gcggccgcucuagaacuaguggaucccccccccccgcuccccaaaugacguaacugucccugcagcuucuagauagcuuuucgcagcgucuccgaccggccgggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacgucucaaauccccucaaaaaaaaaaaaaaaaaaaaaaaaaaaaaaaaaaaaaaaaaaaacaugggacucaaaguuucagcaucgcgucucuuuugccgaauucgauaucaagcuuaucgauacc

SEQ ID NO: 9 - DNA, 53 bp, Artificial Sequence
  source: /note="Description of Artificial Sequence: Synthetic oligonucleotide"
agtcagtcagtcagtcagtcagtccccggggactgactgactgactgactgac

SEQ ID NO: 10 - RNA, 53 nt, Artificial Sequence
  source: /note="Description of Artificial Sequence: Synthetic oligonucleotide"
agucagucagucagucagucaguccccggggacugacugacugacugacugac

SEQ ID NO: 11 - DNA, 717 bp, Artificial Sequence
  source: /note="Description of Artificial Sequence: Synthetic polynucleotide"
atgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcctgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataa

SEQ ID NO: 12 - protein, 238 aa, Artificial Sequence
  source: /note="Description of Artificial Sequence: Synthetic polypeptide"
MSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 13 - DNA, 521 bp, Artificial Sequence
  source: /note="Description of Artificial Sequence: Synthetic polynucleotide"
agcttatggtgccccaaccccaacgcggaaaaggttccgtcgggacccaaacgcgtccctgcgccgacgagacccgcaccaaggccctttgcgtcgccgcggctgggacccagagcgtgtaagaagtgcaggcaagcgtcgcagtgggcctagaagcggcgatgggaacacccggggggccgctgcgaaggacgaggcggggattcagcccttccaaggaacgccaagcgccgcacggcctgcactatttgccttcggcgtgcagagtgatcatgggagcgtctgcctgtcgcggtccctcgttaccgtcgcgcggctggcgctacccgacaccggttatcgccgacgagtcgtcccgcgcggctctcgtcgccggcccttccccgccacgccctccgccccacaccccgccatcacacccgggacaaggacgggcgcgccacaaggcgtaagacgttcggaggcctcgcgtgcagccgtcagccgagggagcaactggcttagtggctggagagaggggt

SEQ ID NO: 14 - DNA, 726 bp, Artificial Sequence
  source: /note="Description of Artificial Sequence: Synthetic polynucleotide"
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 15 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 16 - DNA, 1654 bp, Artificial Sequence
  source: /note="Description of Artificial Sequence: Synthetic polynucleotide"
gattactgggggcaaggcacgtcagtgacagtgagttcaatcctggactacagcttcacaggtggcgctgggcgcgacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaaccccctgtatgaccagtactgcaaggaccacttcagtgatggccactgcgaccagggctgtaacagtgccgaatgtgagtgggatggcctagactgtgctgagcatgtacccgagcggctggcagccggcaccctggtgctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtggctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagccggtggagcctccgctgccctcgcagctgcacctcatgtacgtggcagcggccgccttcgtgctcctgttctttgtgggctgtggggtgctgctgtcccgcaagcgccggcggatgaagctgctgagcagcatcgagcaggcctgtgacatctgccggctgaagaaactgaagtgcagcaaagaaaagcccaagtgcgccaagtgcctgaagaacaactgggagtgccggtacagccccaagaccaagagaagccccctgaccagagcccacctgaccgaggtggaaagccggctggaaagactggaacagctgtttctgctgatcttcccacgcgaggacctggacatgatcctgaagatggacagcctgcaggacatcaaggccctgctgaccggcctgttcgtgcaggacaacgtgaacaaggacgccgtgaccgacagactggccagcgtggaaaccgacatgcccctgaccctgcggcagcacagaatcagcgccaccagcagcagcgaggaaagcagcaacaagggccagcggcagctgacagtgtctgctgctgcaggcggaagcggaggctctggcggatctgatgccctggacgacttcgacctggatatgctgggcagcgacgccctggatgattttgatctggacatgctgggatctgacgctctggacgatttcgatctcgacatgttgggatcagatgcactggatgactttgacctggacatgctcggatcatgag

SEQ ID NO: 17 - protein, 550 aa, Artificial Sequence
  source: /note="Description of Artificial Sequence: Synthetic polypeptide"
DYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 18 - DNA, 124 bp, Artificial Sequence
  source: /note="Description of Artificial Sequence: Synthetic polynucleotide"
ggagcactgtcctccgaacgtcggagcactgtcctccgaacgtcggagcactgtcctccgaacgtcggagcactgtcctccgaacggagcatgtcctccgaacgtcggagcactgtcctccgaa

SEQ ID NO: 19 - DNA, 635 bp, Artificial Sequence
  source: /note="Description of Artificial Sequence: Synthetic polynucleotide"
ggagcactgtcctccgaacgtcggagcactgtcctccgaacgtcggagcactgtcctccgaacgtcggagcactgtcctccgaacggagcatgtcctccgaacgtcggagcactgtcctccgaatctagaccgcgggcggccgctctagaactagtggatcccccccccccgctccccaaatgacgtaactgtccctgcagcttctagatagcttttcgcagcgtctccgaccggccgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagacgtctcaaatcccctcaaaaaaaaaaaaaaaaaaaaaaaaaaaaaaaaaaaaaaaaaaaacatgggactcaaagtttcagcatcgcgtctcttttgccgaattcgatatcaagcttatcgatacc

SEQ ID NO: 20 - DNA, 2386 bp, Artificial Sequence
  source: /note="Description of Artificial Sequence: Synthetic polynucleotide"
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaccgcgggattactgggggcaaggcacgtcagtgacagtgagttcaatcctggactacagcttcacaggtggcgctgggcgcgacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaaccccctgtatgaccagtactgcaaggaccacttcagtgatggccactgcgaccagggctgtaacagtgccgaatgtgagtgggatggcctagactgtgctgagcatgtacccgagcggctggcagccggcaccctggtgctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtggctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagccggtggagcctccgctgccctcgcagctgcacctcatgtacgtggcagcggccgccttcgtgctcctgttctttgtgggctgtggggtgctgctgtcccgcaagcgccggcggatgaagctgctgagcagcatcgagcaggcctgtgacatctgccggctgaagaaactgaagtgcagcaaagaaaagcccaagtgcgccaagtgcctgaagaacaactgggagtgccggtacagccccaagaccaagagaagccccctgaccagagcccacctgaccgaggtggaaagccggctggaaagactggaacagctgtttctgctgatcttcccacgcgaggacctggacatgatcctgaagatggacagcctgcaggacatcaaggccctgctgaccggcctgttcgtgcaggacaacgtgaacaaggacgccgtgaccgacagactggccagcgtggaaaccgacatgcccctgaccctgcggcagcacagaatcagcgccaccagcagcagcgaggaaagcagcaacaagggccagcggcagctgacagtgtctgctgctgcaggcggaagcggaggctctggcggatctgatgccctggacgacttcgacctggatatgctgggcagcgacgccctggatgattttgatctggacatgctgggatctgacgctctggacgatttcgatctcgacatgttgggatcagatgcactggatgactttgacctggacatgctcggatcatgag

SEQ ID NO: 21 - protein, 794 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 22 - DNA, 1590 bp, Artificial Sequence
  source: /note="Description of Artificial Sequence: Synthetic polynucleotide"
agtcagtcagtcagtcagtcagtccccggggactgactgactgactgactgacgtcgactggaagcggagctactaacttcagcctgctgaagcaggctggagacgtggaggagaaccctggacctcctaggatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 23 - DNA, 66 bp, Artificial Sequence
  source: /note="Description of Artificial Sequence: Synthetic oligonucleotide"
ggaagcggagctactaacttcagcctgctgaagcaggctggagacgtggaggagaaccctggacct

SEQ ID NO: 24 - protein, 22 aa, Artificial Sequence
  source: /note="Description of Artificial Sequence: Synthetic peptide"
GSGATNFSLLKQAGDVEENPGP

SEQ ID NO: 25 - DNA, 1395 bp, Artificial Sequence
  source: /note="Description of Artificial Sequence: Synthetic polynucleotide"
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 26 - protein, 465 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 27 - DNA, 190 bp, Artificial Sequence
  source: /note="Description of Artificial Sequence: Synthetic polynucleotide"
ggagcactgtcctccgaacgtcggagcactgtcctccgaacgtcggagcactgtcctccgaacgtcggagcactgtcctccgaacggagcatgtcctccgaacgtcggagcactgtcctccgaatctagaagtcagtcagtcagtcagtcagtccccggggactgactgactgactgactgacgtcgact

SEQ ID NO: 28 - protein, 40 aa, Artificial Sequence
  source: /note="Description of Artificial Sequence: Synthetic polypeptide"
  SITE (1)..(40): /note="This sequence may encompass 1-10 'Gly Gly Gly Ser' repeating units"
GGGSGGGSGGGSGGGSGGGSGGGSGGGSGGGSGGGSGGGS

SEQ ID NO: 29 - protein, 20 aa, Artificial Sequence
  source: /note="Description of Artificial Sequence: Synthetic peptide"
GGGGSGGGGSGGGGSGGGGS

SEQ ID NO: 30 - protein, 15 aa, Artificial Sequence
  source: /note="Description of Artificial Sequence: Synthetic peptide"
GGGGSGGGGSGGGGS

SEQ ID NO: 31 - protein, 4 aa, Artificial Sequence
  source: /note="Description of Artificial Sequence: Synthetic peptide"
GGGS

SEQ ID NO: 32 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 33 - DNA, 63 bp, Artificial Sequence
  source: /note="Description of Artificial Sequence: Synthetic oligonucleotide"
atggccctccctgtcaccgccctgctgcttccgctggctcttctgctccacgccgctcggccc

SEQ ID NO: 34 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 35 - protein, 17 aa, Artificial Sequence
  source: /note="Description of Artificial Sequence: Synthetic peptide"
ASGGGGSGGRASGGGGS

SEQ ID NO: 36-37 - skipped (2 entries)

SEQ ID NO: 38 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 39 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 40 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 41 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 42 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 43 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 44 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 45 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 46 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 47 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 48 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 49 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 50 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 51 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 52 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 53 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 54 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 55 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 56 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 57 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 58 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 59 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 60 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 61 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 62 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 63 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 64 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 65 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 66 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 67 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 68 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 69 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 70 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 71 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 72 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 73 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 74 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 75 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 76 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 77 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 78 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 79 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 80 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 81 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 82 - protein, 115 aa, Artificial Sequence; identical to SEQ ID NO: 76
  source: /note="Description of Artificial Sequence: Synthetic polypeptide"

SEQ ID NO: 83 - protein, 115 aa, Artificial Sequence; identical to SEQ ID NO: 79
  source: /note="Description of Artificial Sequence: Synthetic polypeptide"

SEQ ID NO: 84 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 85 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 86 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 87 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 88 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 89 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 90 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 91 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 92 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 93 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 94 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 95 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 96 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 97 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 98 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 99 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 100 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 101 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 102 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 103 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 104 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 105 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 106 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 107 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 108 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 109 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 110 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 111 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 112 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 113 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 114 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 115 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 116 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 117 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 118 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 119 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 120 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 121 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 122 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 123 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 124 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 125 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 126 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 127 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 128 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 129 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 130 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 131 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 132 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 133 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 134 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 135 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 136 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 137 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 138 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 139 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 140 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 141 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 142 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 143 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 144 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 145 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 146 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 147 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 148 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 149 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 150 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 151 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 152 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 153 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 154 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 155 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 156 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 157 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 158 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 159 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 160 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 161 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 162 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 163 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 164 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 165 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 166 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 167 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 168 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 169 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 170 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 171 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 172 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 173 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 174 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 175 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 176 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 177 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 178 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 179 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 180 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 181 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 182 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 183 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 184 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 185 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 186 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 187 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 188 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 189 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 190 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 191 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 192 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 193 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 194 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 195 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 196 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 197 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 198 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 199 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 200 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 201 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 202 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 203 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 204 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 205 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 206 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 207 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 208 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 209 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 210 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 211 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 212 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 213 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 215 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 219 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 222 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 223 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 224 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 225 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 226 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 228 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 229 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 232 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 233 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 234 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 235 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 236 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 237 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 238 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 239 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 240 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 241 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 242 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 243 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 244 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 245 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 246 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 247 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 248 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 249 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 250 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 251 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 252 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 253 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 254 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 255-274 - skipped (20 entries)

SEQ ID NO: 275 - protein, 239 aa, Artificial Sequence
  source: /note="Description of Artificial Sequence: Synthetic polypeptide"
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 276-277 - skipped (2 entries)

SEQ ID NO: 278 - protein, 383 aa, Artificial Sequence
  source: /note="Description of Artificial Sequence: Synthetic polypeptide"
MALPVTALLLPLALLLHAARPQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPA

SEQ ID NO: 279-383 - skipped (105 entries)

SEQ ID NO: 384 - protein, 5 aa, Artificial Sequence
  source: /note="Description of Artificial Sequence: Synthetic peptide"
NYAMS

SEQ ID NO: 385 - protein, 5 aa, Artificial Sequence
  source: /note="Description of Artificial Sequence: Synthetic peptide"
DYAMH

SEQ ID NO: 386 - protein, 5 aa, Artificial Sequence
  source: /note="Description of Artificial Sequence: Synthetic peptide"
NHGMS

SEQ ID NO: 387 - protein, 5 aa, Artificial Sequence
  source: /note="Description of Artificial Sequence: Synthetic peptide"
NFGIN

SEQ ID NO: 388 - protein, 5 aa, Artificial Sequence
  source: /note="Description of Artificial Sequence: Synthetic peptide"
SDAMT

SEQ ID NO: 389 - protein, 5 aa, Artificial Sequence
  source: /note="Description of Artificial Sequence: Synthetic peptide"
NYGIT

SEQ ID NO: 390 - protein, 5 aa, Artificial Sequence
  source: /note="Description of Artificial Sequence: Synthetic peptide"
NHGMS

SEQ ID NO: 391 - protein, 5 aa, Artificial Sequence
  source: /note="Description of Artificial Sequence: Synthetic peptide"
NHGMS

SEQ ID NO: 392 - protein, 462 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 393 - protein, 445 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 394 - protein, 5 aa, Artificial Sequence
  source: /note="Description of Artificial Sequence: Synthetic peptide"
NHGMS

SEQ ID NO: 395 - protein, 5 aa, Artificial Sequence
  source: /note="Description of Artificial Sequence: Synthetic peptide"
DYYMS

SEQ ID NO: 396 - protein, 5 aa, Artificial Sequence
  source: /note="Description of Artificial Sequence: Synthetic peptide"
NHGMS

SEQ ID NO: 397 - protein, 5 aa, Artificial Sequence
  source: /note="Description of Artificial Sequence: Synthetic peptide"
NHGMS

SEQ ID NO: 398 - protein, 5 aa, Artificial Sequence
  source: /note="Description of Artificial Sequence: Synthetic peptide"
NHGMS

SEQ ID NO: 399 - protein, 7 aa, Artificial Sequence
  source: /note="Description of Artificial Sequence: Synthetic peptide"
SSYYYWG

SEQ ID NO: 400 - protein, 7 aa, Artificial Sequence
  source: /note="Description of Artificial Sequence: Synthetic peptide"
TSGMCVS

SEQ ID NO: 401 - protein, 5 aa, Artificial Sequence
  source: /note="Description of Artificial Sequence: Synthetic peptide"
SYSMN

SEQ ID NO: 402 - protein, 5 aa, Artificial Sequence
  source: /note="Description of Artificial Sequence: Synthetic peptide"
DYYMS

SEQ ID NO: 403 - protein, 5 aa, Artificial Sequence
  source: /note="Description of Artificial Sequence: Synthetic peptide"
SHYIH

SEQ ID NO: 404 - protein, 7 aa, Artificial Sequence
  source: /note="Description of Artificial Sequence: Synthetic peptide"
SGGYYWS

SEQ ID NO: 405 - protein, 5 aa, Artificial Sequence
  source: /note="Description of Artificial Sequence: Synthetic peptide"
SYAIS

SEQ ID NO: 406 - protein, 7 aa, Artificial Sequence
  source: /note="Description of Artificial Sequence: Synthetic peptide"
SNSAAWN

SEQ ID NO: 407 - protein, 5 aa, Artificial Sequence
  source: /note="Description of Artificial Sequence: Synthetic peptide"
SYAMS

SEQ ID NO: 408 - protein, 5 aa, Artificial Sequence
  source: /note="Description of Artificial Sequence: Synthetic peptide"
RYPMS

SEQ ID NO: 409 - protein, 5 aa, Artificial Sequence
  source: /note="Description of Artificial Sequence: Synthetic peptide"
SYAMS

SEQ ID NO: 410 - protein, 5 aa, Artificial Sequence
  source: /note="Description of Artificial Sequence: Synthetic peptide"
SYAMS

SEQ ID NO: 411 - protein, 5 aa, Artificial Sequence
  source: /note="Description of Artificial Sequence: Synthetic peptide"
DYAMH

SEQ ID NO: 412 - protein, 5 aa, Artificial Sequence
  source: /note="Description of Artificial Sequence: Synthetic peptide"
DYAMH

SEQ ID NO: 413 - protein, 5 aa, Artificial Sequence
  source: /note="Description of Artificial Sequence: Synthetic peptide"
SYAMS

SEQ ID NO: 414 - protein, 5 aa, Artificial Sequence
  source: /note="Description of Artificial Sequence: Synthetic peptide"
SYAMS

SEQ ID NO: 415 - protein, 5 aa, Artificial Sequence
  source: /note="Description of Artificial Sequence: Synthetic peptide"
SYAMS

SEQ ID NO: 416 - protein, 5 aa, Artificial Sequence
  source: /note="Description of Artificial Sequence: Synthetic peptide"
SYAMS

SEQ ID NO: 417 - protein, 5 aa, Artificial Sequence
  source: /note="Description of Artificial Sequence: Synthetic peptide"
SYAMS

SEQ ID NO: 418 - protein, 5 aa, Artificial Sequence
  source: /note="Description of Artificial Sequence: Synthetic peptide"
SYAMS

SEQ ID NO: 419 - protein, 5 aa, Artificial Sequence
  source: /note="Description of Artificial Sequence: Synthetic peptide"
SYAMS

SEQ ID NO: 420 - protein, 5 aa, Artificial Sequence
  source: /note="Description of Artificial Sequence: Synthetic peptide"
NFGMN

SEQ ID NO: 421 - protein, 5 aa, Artificial Sequence
  source: /note="Description of Artificial Sequence: Synthetic peptide"
DYSIN

SEQ ID NO: 422 - protein, 5 aa, Artificial Sequence
  source: /note="Description of Artificial Sequence: Synthetic peptide"
HYSMN

SEQ ID NO: 423 - protein, 5 aa, Artificial Sequence
  source: /note="Description of Artificial Sequence: Synthetic peptide"
HYSMN

SEQ ID NO: 424 - protein, 17 aa, Artificial Sequence
  source: /note="Description of Artificial Sequence: Synthetic peptide"
GISRSGENTYYADSVKG

SEQ ID NO: 425 - protein, 17 aa, Artificial Sequence
  source: /note="Description of Artificial Sequence: Synthetic peptide"
GISWNSGSIGYADSVKG

SEQ ID NO: 426 - protein, 16 aa, Artificial Sequence
  source: /note="Description of Artificial Sequence: Synthetic peptide"
GIVYSGSTYYAASVKG

SEQ ID NO: 427 - protein, 17 aa, Artificial Sequence
  source: /note="Description of Artificial Sequence: Synthetic peptide"
WINPKNNNTNYAQKFQG

SEQ ID NO: 428 - protein, 17 aa, Artificial Sequence
  source: /note="Description of Artificial Sequence: Synthetic peptide"
VISGSGGTTYYADSVKG

SEQ ID NO: 429 - protein, 17 aa, Artificial Sequence
  source: /note="Description of Artificial Sequence: Synthetic peptide"
WISAYNGNTNYAQKFQG

SEQ ID NO: 430 - protein, 16 aa, Artificial Sequence
  source: /note="Description of Artificial Sequence: Synthetic peptide"
GIVYSGSTYYAASVKG

SEQ ID NO: 431 - protein, 16 aa, Artificial Sequence
  source: /note="Description of Artificial Sequence: Synthetic peptide"
GIVYSGSTYYAASVKG

SEQ ID NO: 432 - protein, 16 aa, Artificial Sequence
  source: /note="Description of Artificial Sequence: Synthetic peptide"
GIVYSGSTYYAASVKG

SEQ ID NO: 433 - protein, 17 aa, Artificial Sequence
  source: /note="Description of Artificial Sequence: Synthetic peptide"
YISSSGSTIYYADSVKG

SEQ ID NO: 434 - protein, 16 aa, Artificial Sequence
  source: /note="Description of Artificial Sequence: Synthetic peptide"
GIVYSGSTYYAASVKG

SEQ ID NO: 435 - protein, 17 aa, Artificial Sequence
  source: /note="Description of Artificial Sequence: Synthetic peptide"
YISSSGNTIYYADSVKG

SEQ ID NO: 436 - protein, 16 aa, Artificial Sequence
  source: /note="Description of Artificial Sequence: Synthetic peptide"
GIVYSGSTYYAASVKG

SEQ ID NO: 437 - protein, 16 aa, Artificial Sequence
  source: /note="Description of Artificial Sequence: Synthetic peptide"
GIVYSGSTYYAASVKG

SEQ ID NO: 438 - protein, 16 aa, Artificial Sequence
  source: /note="Description of Artificial Sequence: Synthetic peptide"
GIVYSGSTYYAASVKG

SEQ ID NO: 439 - protein, 16 aa, Artificial Sequence
  source: /note="Description of Artificial Sequence: Synthetic peptide"
SIYYSGSAYYNPSLKS

SEQ ID NO: 440 - protein, 16 aa, Artificial Sequence
  source: /note="Description of Artificial Sequence: Synthetic peptide"
RIDWDEDKFYSTSLKT

SEQ ID NO: 441 - protein, 17 aa, Artificial Sequence
  source: /note="Description of Artificial Sequence: Synthetic peptide"
SISSSSSYIYYADSVKG

SEQ ID NO: 442 - protein, 17 aa, Artificial Sequence
  source: /note="Description of Artificial Sequence: Synthetic peptide"
YISSSGSTIYYADSVKG

SEQ ID NO: 443 - protein, 17 aa, Artificial Sequence
  source: /note="Description of Artificial Sequence: Synthetic peptide"
MINPSGGVTAYSQTLQG

SEQ ID NO: 444 - protein, 16 aa, Artificial Sequence
  source: /note="Description of Artificial Sequence: Synthetic peptide"
YIYYSGSTYYNPSLKS

SEQ ID NO: 445 - protein, 17 aa, Artificial Sequence
  source: /note="Description of Artificial Sequence: Synthetic peptide"
GIIPIFGTANYAQKFQG

SEQ ID NO: 446 - protein, 18 aa, Artificial Sequence
  source: /note="Description of Artificial Sequence: Synthetic peptide"
RTYYRSKWYSFYAISLKS

SEQ ID NO: 447 - protein, 17 aa, Artificial Sequence
  source: /note="Description of Artificial Sequence: Synthetic peptide"
AISGSGGSTYYADSVKG

SEQ ID NO: 448 - protein, 17 aa, Artificial Sequence
  source: /note="Description of Artificial Sequence: Synthetic peptide"
GISDSGVSTYYADSAKG

SEQ ID NO: 449 - protein, 17 aa, Artificial Sequence
  source: /note="Description of Artificial Sequence: Synthetic peptide"
AISGSGGSTYYADSVKG

SEQ ID NO: 450 - protein, 17 aa, Artificial Sequence
  source: /note="Description of Artificial Sequence: Synthetic peptide"
AISGSGGSTYYADSVKG

SEQ ID NO: 451 - protein, 17 aa, Artificial Sequence
  source: /note="Description of Artificial Sequence: Synthetic peptide"
GISWNSGSIGYADSVKG

SEQ ID NO: 452 - protein, 17 aa, Artificial Sequence
  source: /note="Description of Artificial Sequence: Synthetic peptide"
SINWKGNSLAYGDSVKG

SEQ ID NO: 453 - protein, 17 aa, Artificial Sequence
  source: /note="Description of Artificial Sequence: Synthetic peptide"
AISGSGGSTYYADSVKG

SEQ ID NO: 454 - protein, 17 aa, Artificial Sequence
  source: /note="Description of Artificial Sequence: Synthetic peptide"
AISGSGGSTYYADSVKG

SEQ ID NO: 455 - protein, 17 aa, Artificial Sequence
  source: /note="Description of Artificial Sequence: Synthetic peptide"
AISGSGGSTYYADSVKG

SEQ ID NO: 456 - protein, 17 aa, Artificial Sequence
  source: /note="Description of Artificial Sequence: Synthetic peptide"
AISGSGGSTYYADSVKG

SEQ ID NO: 457 - protein, 17 aa, Artificial Sequence
  source: /note="Description of Artificial Sequence: Synthetic peptide"
AISGSGGSTYYADSVKG

SEQ ID NO: 458 - protein, 17 aa, Artificial Sequence
  source: /note="Description of Artificial Sequence: Synthetic peptide"
AISGSGGSTYYADSVKG

SEQ ID NO: 459 - protein, 17 aa, Artificial Sequence
  source: /note="Description of Artificial Sequence: Synthetic peptide"
AISGSGGSTYYADSVKG

SEQ ID NO: 460 - protein, 17 aa, Artificial Sequence
  source: /note="Description of Artificial Sequence: Synthetic peptide"
WINTYTGESYFADDFKG

SEQ ID NO: 461 - protein, 17 aa, Artificial Sequence
  source: /note="Description of Artificial Sequence: Synthetic peptide"
WINTETREPAYAYDFRG

SEQ ID NO: 462 - protein, 17 aa, Artificial Sequence
  source: /note="Description of Artificial Sequence: Synthetic peptide"
RINTESGVPIYADDFKG

SEQ ID NO: 463 - protein, 17 aa, Artificial Sequence
  source: /note="Description of Artificial Sequence: Synthetic peptide"
RINTETGEPLYADDFKG

SEQ ID NO: 464 - protein, 11 aa, Artificial Sequence
  source: /note="Description of Artificial Sequence: Synthetic peptide"
SPAHYYGGMDV

SEQ ID NO: 465 - protein, 6 aa, Artificial Sequence
  source: /note="Description of Artificial Sequence: Synthetic peptide"
HSFLAY

SEQ ID NO: 466 - protein, 7 aa, Artificial Sequence
  source: /note="Description of Artificial Sequence: Synthetic peptide"
HGGESDV

SEQ ID NO: 467 - protein, 11 aa, Artificial Sequence
  source: /note="Description of Artificial Sequence: Synthetic peptide"
GPYYYQSYMDV

SEQ ID NO: 468 - protein, 14 aa, Artificial Sequence
  source: /note="Description of Artificial Sequence: Synthetic peptide"
LDSSGYYYARGPRY

SEQ ID NO: 469 - protein, 9 aa, Artificial Sequence
  source: /note="Description of Artificial Sequence: Synthetic peptide"
GPYYYYMDV

SEQ ID NO: 470 - protein, 7 aa, Artificial Sequence
  source: /note="Description of Artificial Sequence: Synthetic peptide"
HGGESDV

SEQ ID NO: 471 - protein, 7 aa, Artificial Sequence
  source: /note="Description of Artificial Sequence: Synthetic peptide"
HGGESDV

SEQ ID NO: 472 - protein, 7 aa, Artificial Sequence
  source: /note="Description of Artificial Sequence: Synthetic peptide"
HGGESDV

SEQ ID NO: 473 - protein, 8 aa, Artificial Sequence
  source: /note="Description of Artificial Sequence: Synthetic peptide"
ESGDGMDV

SEQ ID NO: 474 - protein, 7 aa, Artificial Sequence
  source: /note="Description of Artificial Sequence: Synthetic peptide"
HGGESDV

SEQ ID NO: 475 - protein, 8 aa, Artificial Sequence
  source: /note="Description of Artificial Sequence: Synthetic peptide"
STMVREDY

SEQ ID NO: 476 - protein, 7 aa, Artificial Sequence
  source: /note="Description of Artificial Sequence: Synthetic peptide"
HGGESDV

SEQ ID NO: 477 - protein, 7 aa, Artificial Sequence
  source: /note="Description of Artificial Sequence: Synthetic peptide"
HGGESDV

SEQ ID NO: 478 - protein, 7 aa, Artificial Sequence
  source: /note="Description of Artificial Sequence: Synthetic peptide"
HGGESDV

SEQ ID NO: 479 - protein, 11 aa, Artificial Sequence
  source: /note="Description of Artificial Sequence: Synthetic peptide"
HWQEWPDAFDI

SEQ ID NO: 480 - protein, 13 aa, Artificial Sequence
  source: /note="Description of Artificial Sequence: Synthetic peptide"
SGAGGTSATAFDI

SEQ ID NO: 481 - protein, 10 aa, Artificial Sequence
  source: /note="Description of Artificial Sequence: Synthetic peptide"
TIAAVYAFDI

SEQ ID NO: 482 - protein, 8 aa, Artificial Sequence
  source: /note="Description of Artificial Sequence: Synthetic peptide"
DLRGAFDI

SEQ ID NO: 483 - protein, 11 aa, Artificial Sequence
  source: /note="Description of Artificial Sequence: Synthetic peptide"
EGSGSGWYFDF

SEQ ID NO: 484 - protein, 13 aa, Artificial Sequence
  source: /note="Description of Artificial Sequence: Synthetic peptide"
AGIAARLRGAFDI

SEQ ID NO: 485 - protein, 20 aa, Artificial Sequence
  source: /note="Description of Artificial Sequence: Synthetic peptide"
RGGYQLLRWDVGLLRSAFDI

SEQ ID NO: 486 - protein, 13 aa, Artificial Sequence
  source: /note="Description of Artificial Sequence: Synthetic peptide"
SSPEGLFLYWFDP

SEQ ID NO: 487 - protein, 9 aa, Artificial Sequence
  source: /note="Description of Artificial Sequence: Synthetic peptide"
VEGSGSLDY

SEQ ID NO: 488 - protein, 9 aa, Artificial Sequence
  source: /note="Description of Artificial Sequence: Synthetic peptide"
RAGSEASDI

SEQ ID NO: 489 - protein, 15 aa, Artificial Sequence
  source: /note="Description of Artificial Sequence: Synthetic peptide"
ATYKRELRYYYGMDV

SEQ ID NO: 490 - protein, 15 aa, Artificial Sequence
  source: /note="Description of Artificial Sequence: Synthetic peptide"
ATYKRELRYYYGMDV

SEQ ID NO: 491 - protein, 8 aa, Artificial Sequence
  source: /note="Description of Artificial Sequence: Synthetic peptide"
VGKAVPDV

SEQ ID NO: 492 - protein, 13 aa, Artificial Sequence
  source: /note="Description of Artificial Sequence: Synthetic peptide"
HQGVAYYNYAMDV

SEQ ID NO: 493 - protein, 8 aa, Artificial Sequence
  source: /note="Description of Artificial Sequence: Synthetic peptide"
VVRDGMDV

SEQ ID NO: 494 - protein, 9 aa, Artificial Sequence
  source: /note="Description of Artificial Sequence: Synthetic peptide"
IPQTGTFDY

SEQ ID NO: 495 - protein, 15 aa, Artificial Sequence
  source: /note="Description of Artificial Sequence: Synthetic peptide"
ANYKRELRYYYGMDV

SEQ ID NO: 496 - protein, 11 aa, Artificial Sequence
  source: /note="Description of Artificial Sequence: Synthetic peptide"
ALVGATGAFDI

SEQ ID NO: 497 - protein, 8 aa, Artificial Sequence
  source: /note="Description of Artificial Sequence: Synthetic peptide"
WFGEGFDP

SEQ ID NO: 498 - protein, 17 aa, Artificial Sequence
  source: /note="Description of Artificial Sequence: Synthetic peptide"
VGYDSSGYYRDYYGMDV

SEQ ID NO: 499 - protein, 13 aa, Artificial Sequence
  source: /note="Description of Artificial Sequence: Synthetic peptide"
MGWSSGYLGAFDI

SEQ ID NO: 500 - protein, 13 aa, Artificial Sequence
  source: /note="Description of Artificial Sequence: Synthetic peptide"
GEIYYGYDGGFAY

SEQ ID NO: 501 - protein, 8 aa, Artificial Sequence
  source: /note="Description of Artificial Sequence: Synthetic peptide"
DYSYAMDY

SEQ ID NO: 502 - protein, 8 aa, Artificial Sequence
  source: /note="Description of Artificial Sequence: Synthetic peptide"
DYLYSLDF

SEQ ID NO: 503 - protein, 8 aa, Artificial Sequence
  source: /note="Description of Artificial Sequence: Synthetic peptide"
DYLYSCDY

SEQ ID NO: 504 - protein, 12 aa, Artificial Sequence
  source: /note="Description of Artificial Sequence: Synthetic peptide"
RASQSISSSFLA

SEQ ID NO: 505 - protein, 16 aa, Artificial Sequence
  source: /note="Description of Artificial Sequence: Synthetic peptide"
RSSQSLLHSNGYNYLD

SEQ ID NO: 506 - protein, 16 aa, Artificial Sequence
  source: /note="Description of Artificial Sequence: Synthetic peptide"
KSSQSLLRNDGKTPLY

SEQ ID NO: 507 - protein, 16 aa, Artificial Sequence
  source: /note="Description of Artificial Sequence: Synthetic peptide"
RSSQSLLHSNGYNYLN

SEQ ID NO: 508 - protein, 11 aa, Artificial Sequence
  source: /note="Description of Artificial Sequence: Synthetic peptide"
RASQSISSYLN

SEQ ID NO: 509 - protein, 16 aa, Artificial Sequence
  source: /note="Description of Artificial Sequence: Synthetic peptide"
RSSQSLLYSNGYNYVD

SEQ ID NO: 510 - protein, 11 aa, Artificial Sequence
  source: /note="Description of Artificial Sequence: Synthetic peptide"
RASQSVSSNLA

SEQ ID NO: 511 - protein, 11 aa, Artificial Sequence
  source: /note="Description of Artificial Sequence: Synthetic peptide"
RASQSVSSKLA

SEQ ID NO: 512 - protein, 12 aa, Artificial Sequence
  source: /note="Description of Artificial Sequence: Synthetic peptide"
RASQSVGSTNLA

SEQ ID NO: 513 - protein, 11 aa, Artificial Sequence
  source: /note="Description of Artificial Sequence: Synthetic peptide"
RASQSISSYLN

SEQ ID NO: 514 - protein, 11 aa, Artificial Sequence
  source: /note="Description of Artificial Sequence: Synthetic peptide"
RASQSISSYLN

SEQ ID NO: 515 - protein, 16 aa, Artificial Sequence
  source: /note="Description of Artificial Sequence: Synthetic peptide"
KSSESLVHNSGKTYLN

SEQ ID NO: 516 - protein, 11 aa, Artificial Sequence
  source: /note="Description of Artificial Sequence: Synthetic peptide"
QASEDINKFLN

SEQ ID NO: 517 - protein, 11 aa, Artificial Sequence
  source: /note="Description of Artificial Sequence: Synthetic peptide"
RASQSVGSNLA

SEQ ID NO: 518 - protein, 12 aa, Artificial Sequence
  source: /note="Description of Artificial Sequence: Synthetic peptide"
RASQSIGSSSLA

SEQ ID NO: 519 - protein, 11 aa, Artificial Sequence
  source: /note="Description of Artificial Sequence: Synthetic peptide"
KASQDIDDAMN

SEQ ID NO: 520 - protein, 11 aa, Artificial Sequence
  source: /note="Description of Artificial Sequence: Synthetic peptide"
RASQDIYNNLA

SEQ ID NO: 521 - protein, 16 aa, Artificial Sequence
  source: /note="Description of Artificial Sequence: Synthetic peptide"
RSSQSLLHSNGYNYLD

SEQ ID NO: 522 - protein, 11 aa, Artificial Sequence
  source: /note="Description of Artificial Sequence: Synthetic peptide"
GGNNIGTKSVH

SEQ ID NO: 523 - protein, 11 aa, Artificial Sequence
  source: /note="Description of Artificial Sequence: Synthetic peptide"
SGDGLSKKYVS

SEQ ID NO: 524 - protein, 11 aa, Artificial Sequence
  source: /note="Description of Artificial Sequence: Synthetic peptide"
RASQGIRNWLA

SEQ ID NO: 525 - protein, 11 aa, Artificial Sequence
  source: /note="Description of Artificial Sequence: Synthetic peptide"
GGNNIGSKSVH

SEQ ID NO: 526 - protein, 11 aa, Artificial Sequence
  source: /note="Description of Artificial Sequence: Synthetic peptide"
QGDSLGNYYAT

SEQ ID NO: 527 - protein, 12 aa, Artificial Sequence
  source: /note="Description of Artificial Sequence: Synthetic peptide"
RASQSVSSAYLA

SEQ ID NO: 528 - protein, 11 aa, Artificial Sequence
  source: /note="Description of Artificial Sequence: Synthetic peptide"
RASQSVSNSLA

SEQ ID NO: 529 - protein, 12 aa, Artificial Sequence
  source: /note="Description of Artificial Sequence: Synthetic peptide"
RASQSVSSSFLA

SEQ ID NO: 530 - protein, 12 aa, Artificial Sequence
  source: /note="Description of Artificial Sequence: Synthetic peptide"
RASQSVSTTFLA

SEQ ID NO: 531 - protein, 11 aa, Artificial Sequence
  source: /note="Description of Artificial Sequence: Synthetic peptide"
RASQSISSYLN

SEQ ID NO: 532 - protein, 12 aa, Artificial Sequence
  source: /note="Description of Artificial Sequence: Synthetic peptide"
RATQSIGSSFLA

SEQ ID NO: 533 - protein, 12 aa, Artificial Sequence
  source: /note="Description of Artificial Sequence: Synthetic peptide"
RASQSVSSSYLA

SEQ ID NO: 534 - protein, 12 aa, Artificial Sequence
  source: /note="Description of Artificial Sequence: Synthetic peptide"
RASQSVSSSYLA

SEQ ID NO: 535 - protein, 12 aa, Artificial Sequence
  source: /note="Description of Artificial Sequence: Synthetic peptide"
RASQRVASNYLA

SEQ ID NO: 536 - protein, 12 aa, Artificial Sequence
  source: /note="Description of Artificial Sequence: Synthetic peptide"
RASQSLSSNFLA

SEQ ID NO: 537 - protein, 16 aa, Artificial Sequence
  source: /note="Description of Artificial Sequence: Synthetic peptide"
RSSQSLLHSNGYNYLD

SEQ ID NO: 538 - protein, 12 aa, Artificial Sequence
  source: /note="Description of Artificial Sequence: Synthetic peptide"
RASQSVSSSYLA

SEQ ID NO: 539 - protein, 12 aa, Artificial Sequence
  source: /note="Description of Artificial Sequence: Synthetic peptide"
RASQSVASSFLA

SEQ ID NO: 540 - protein, 11 aa, Artificial Sequence
  source: /note="Description of Artificial Sequence: Synthetic peptide"
RASQDVNTAVS

SEQ ID NO: 541 - protein, 15 aa, Artificial Sequence
  source: /note="Description of Artificial Sequence: Synthetic peptide"
RASESVSVIGAHLIH

SEQ ID NO: 542 - protein, 15 aa, Artificial Sequence
  source: /note="Description of Artificial Sequence: Synthetic peptide"
RASESVTILGSHLIY

SEQ ID NO: 543 - protein, 15 aa, Artificial Sequence
  source: /note="Description of Artificial Sequence: Synthetic peptide"
RASESVTILGSHLIY

SEQ ID NO: 544 - protein, 7 aa, Artificial Sequence
  source: /note="Description of Artificial Sequence: Synthetic peptide"
GASRRAT

SEQ ID NO: 545 - protein, 7 aa, Artificial Sequence
  source: /note="Description of Artificial Sequence: Synthetic peptide"
LGSNRAS

SEQ ID NO: 546 - protein, 7 aa, Artificial Sequence
  source: /note="Description of Artificial Sequence: Synthetic peptide"
EVSNRFS

SEQ ID NO: 547 - protein, 7 aa, Artificial Sequence
  source: /note="Description of Artificial Sequence: Synthetic peptide"
LGSKRAS

SEQ ID NO: 548 - protein, 7 aa, Artificial Sequence
  source: /note="Description of Artificial Sequence: Synthetic peptide"
GASTLAS

SEQ ID NO: 549 - protein, 7 aa, Artificial Sequence
  source: /note="Description of Artificial Sequence: Synthetic peptide"
LGSNRAS

SEQ ID NO: 550 - protein, 7 aa, Artificial Sequence
  source: /note="Description of Artificial Sequence: Synthetic peptide"
GASTRAS

SEQ ID NO: 551 - protein, 7 aa, Artificial Sequence
  source: /note="Description of Artificial Sequence: Synthetic peptide"
GASIRAT

SEQ ID NO: 552 - protein, 7 aa, Artificial Sequence
  source: /note="Description of Artificial Sequence: Synthetic peptide"
DASNRAT

SEQ ID NO: 553 - protein, 7 aa, Artificial Sequence
  source: /note="Description of Artificial Sequence: Synthetic peptide"
AASSLQS

SEQ ID NO: 554 - protein, 7 aa, Artificial Sequence
  source: /note="Description of Artificial Sequence: Synthetic peptide"
AASSLQS

SEQ ID NO: 555 - protein, 7 aa, Artificial Sequence
  source: /note="Description of Artificial Sequence: Synthetic peptide"
EVSNRDS

SEQ ID NO: 556 - protein, 7 aa, Artificial Sequence
  source: /note="Description of Artificial Sequence: Synthetic peptide"
DASTLQT

SEQ ID NO: 557 - protein, 7 aa, Artificial Sequence
  source: /note="Description of Artificial Sequence: Synthetic peptide"
GASTRAT

SEQ ID NO: 558 - protein, 7 aa, Artificial Sequence
  source: /note="Description of Artificial Sequence: Synthetic peptide"
GASSRAS

SEQ ID NO: 559 - protein, 7 aa, Artificial Sequence
  source: /note="Description of Artificial Sequence: Synthetic peptide"
SATSPVP

SEQ ID NO: 560 - protein, 7 aa, Artificial Sequence
  source: /note="Description of Artificial Sequence: Synthetic peptide"
AANKSQS

SEQ ID NO: 561 - protein, 7 aa, Artificial Sequence
  source: /note="Description of Artificial Sequence: Synthetic peptide"
LGSNRAS

SEQ ID NO: 562 - protein, 7 aa, Artificial Sequence
  source: /note="Description of Artificial Sequence: Synthetic peptide"
DDSVRPS

SEQ ID NO: 563 - protein, 7 aa, Artificial Sequence
  source: /note="Description of Artificial Sequence: Synthetic peptide"
RDKERPS

SEQ ID NO: 564 - protein, 7 aa, Artificial Sequence
  source: /note="Description of Artificial Sequence: Synthetic peptide"
AASNLQS

SEQ ID NO: 565 - protein, 7 aa, Artificial Sequence
  source: /note="Description of Artificial Sequence: Synthetic peptide"
GKNNRPS

SEQ ID NO: 566 - protein, 7 aa, Artificial Sequence
  source: /note="Description of Artificial Sequence: Synthetic peptide"
GTNNRPS

SEQ ID NO: 567 - protein, 7 aa, Artificial Sequence
  source: /note="Description of Artificial Sequence: Synthetic peptide"
GASTRAT

SEQ ID NO: 568 - protein, 7 aa, Artificial Sequence
  source: /note="Description of Artificial Sequence: Synthetic peptide"
DASSRAT

SEQ ID NO: 569 - protein, 7 aa, Artificial Sequence
  source: /note="Description of Artificial Sequence: Synthetic peptide"
GASSRAT

SEQ ID NO: 570 - protein, 7 aa, Artificial Sequence
  source: /note="Description of Artificial Sequence: Synthetic peptide"
GSSNRAT

SEQ ID NO: 571 - protein, 7 aa, Artificial Sequence
  source: /note="Description of Artificial Sequence: Synthetic peptide"
AASSLQS

SEQ ID NO: 572 - protein, 7 aa, Artificial Sequence
  source: /note="Description of Artificial Sequence: Synthetic peptide"
GASQRAT

SEQ ID NO: 573 - protein, 7 aa, Artificial Sequence
  source: /note="Description of Artificial Sequence: Synthetic peptide"
GASSRAT

SEQ ID NO: 574 - protein, 7 aa, Artificial Sequence
  source: /note="Description of Artificial Sequence: Synthetic peptide"
GASSRAT

SEQ ID NO: 575 - protein, 7 aa, Artificial Sequence
  source: /note="Description of Artificial Sequence: Synthetic peptide"
GASSRAT

SEQ ID NO: 576 - protein, 7 aa, Artificial Sequence
  source: /note="Description of Artificial Sequence: Synthetic peptide"
GASNWAT

SEQ ID NO: 577 - protein, 7 aa, Artificial Sequence
  source: /note="Description of Artificial Sequence: Synthetic peptide"
LGSNRAS

SEQ ID NO: 578 - protein, 7 aa, Artificial Sequence
  source: /note="Description of Artificial Sequence: Synthetic peptide"
GTSSRAT

SEQ ID NO: 579 - protein, 7 aa, Artificial Sequence
  source: /note="Description of Artificial Sequence: Synthetic peptide"
GASGRAT

SEQ ID NO: 580 - protein, 7 aa, Artificial Sequence
  source: /note="Description of Artificial Sequence: Synthetic peptide"
SASYRYT

SEQ ID NO: 581 - protein, 7 aa, Artificial Sequence
  source: /note="Description of Artificial Sequence: Synthetic peptide"
LASNLET

SEQ ID NO: 582 - protein, 7 aa, Artificial Sequence
  source: /note="Description of Artificial Sequence: Synthetic peptide"
LASNVQT

SEQ ID NO: 583 - protein, 7 aa, Artificial Sequence
  source: /note="Description of Artificial Sequence: Synthetic peptide"
LASNVQT

SEQ ID NO: 584 - protein, 10 aa, Artificial Sequence
  source: /note="Description of Artificial Sequence: Synthetic peptide"
QQYHSSPSWT

SEQ ID NO: 585 - protein, 9 aa, Artificial Sequence
  source: /note="Description of Artificial Sequence: Synthetic peptide"
MQALQTPYT

SEQ ID NO: 586 - protein, 8 aa, Artificial Sequence
  source: /note="Description of Artificial Sequence: Synthetic peptide"
MQNIQFPS

SEQ ID NO: 587 - protein, 9 aa, Artificial Sequence
  source: /note="Description of Artificial Sequence: Synthetic peptide"
MQALQTPYT

SEQ ID NO: 588 - protein, 8 aa, Artificial Sequence
  source: /note="Description of Artificial Sequence: Synthetic peptide"
QQSYKRAS

SEQ ID NO: 589 - protein, 9 aa, Artificial Sequence
  source: /note="Description of Artificial Sequence: Synthetic peptide"
MQGRQFPYS

SEQ ID NO: 590 - protein, 8 aa, Artificial Sequence
  source: /note="Description of Artificial Sequence: Synthetic peptide"
QQYGSSLT

SEQ ID NO: 591 - protein, 9 aa, Artificial Sequence
  source: /note="Description of Artificial Sequence: Synthetic peptide"
QQYGSSSWT

SEQ ID NO: 592 - protein, 10 aa, Artificial Sequence
  source: /note="Description of Artificial Sequence: Synthetic peptide"
QQYGSSPPWT

SEQ ID NO: 593 - protein, 7 aa, Artificial Sequence
  source: /note="Description of Artificial Sequence: Synthetic peptide"
QQSYTLA

SEQ ID NO: 594 - protein, 9 aa, Artificial Sequence
  source: /note="Description of Artificial Sequence: Synthetic peptide"
QQSYSTPYT

SEQ ID NO: 595 - protein, 9 aa, Artificial Sequence
  source: /note="Description of Artificial Sequence: Synthetic peptide"
MQGTHWPGT

SEQ ID NO: 596 - protein, 9 aa, Artificial Sequence
  source: /note="Description of Artificial Sequence: Synthetic peptide"
QQYESLPLT

SEQ ID NO: 597 - protein, 10 aa, Artificial Sequence
  source: /note="Description of Artificial Sequence: Synthetic peptide"
QQYNDWLPVT

SEQ ID NO: 598 - protein, 10 aa, Artificial Sequence
  source: /note="Description of Artificial Sequence: Synthetic peptide"
QQYAGSPPFT

SEQ ID NO: 599 - protein, 9 aa, Artificial Sequence
  source: /note="Description of Artificial Sequence: Synthetic peptide"
LQHDNFPLT

SEQ ID NO: 600 - protein, 9 aa, Artificial Sequence
  source: /note="Description of Artificial Sequence: Synthetic peptide"
QHYYRFPYS

SEQ ID NO: 601 - protein, 9 aa, Artificial Sequence
  source: /note="Description of Artificial Sequence: Synthetic peptide"
MQALQTPYT

SEQ ID NO: 602 - protein, 11 aa, Artificial Sequence
  source: /note="Description of Artificial Sequence: Synthetic peptide"
QVWDSDSEHVV

SEQ ID NO: 603 - protein, 9 aa, Artificial Sequence
  source: /note="Description of Artificial Sequence: Synthetic peptide"
QAWDDTTVV

SEQ ID NO: 604 - protein, 9 aa, Artificial Sequence
  source: /note="Description of Artificial Sequence: Synthetic peptide"
QKYNSAPFT

SEQ ID NO: 605 - protein, 12 aa, Artificial Sequence
  source: /note="Description of Artificial Sequence: Synthetic peptide"
SSRDSSGDHLRV

SEQ ID NO: 606 - protein, 11 aa, Artificial Sequence
  source: /note="Description of Artificial Sequence: Synthetic peptide"
NSRDSSGHHLL

SEQ ID NO: 607 - protein, 14 aa, Artificial Sequence
  source: /note="Description of Artificial Sequence: Synthetic peptide"
QHYGSSFNGSSLFT

SEQ ID NO: 608 - protein, 10 aa, Artificial Sequence
  source: /note="Description of Artificial Sequence: Synthetic peptide"
QQFGTSSGLT

SEQ ID NO: 609 - protein, 10 aa, Artificial Sequence
  source: /note="Description of Artificial Sequence: Synthetic peptide"
QQYHSSPSWT

SEQ ID NO: 610 - protein, 10 aa, Artificial Sequence
  source: /note="Description of Artificial Sequence: Synthetic peptide"
QQYHSSPSWT

SEQ ID NO: 611 - protein, 9 aa, Artificial Sequence
  source: /note="Description of Artificial Sequence: Synthetic peptide"
QQSYSTPYS

SEQ ID NO: 612 - protein, 10 aa, Artificial Sequence
  source: /note="Description of Artificial Sequence: Synthetic peptide"
QHYESSPSWT

SEQ ID NO: 613 - protein, 10 aa, Artificial Sequence
  source: /note="Description of Artificial Sequence: Synthetic peptide"
QQYGSPPRFT

SEQ ID NO: 614 - protein, 10 aa, Artificial Sequence
  source: /note="Description of Artificial Sequence: Synthetic peptide"
QHYGSSPSWT

SEQ ID NO: 615 - protein, 10 aa, Artificial Sequence
  source: /note="Description of Artificial Sequence: Synthetic peptide"
QHYDSSPSWT

SEQ ID NO: 616 - protein, 10 aa, Artificial Sequence
  source: /note="Description of Artificial Sequence: Synthetic peptide"
QYYGTSPMYT

SEQ ID NO: 617 - protein, 9 aa, Artificial Sequence
  source: /note="Description of Artificial Sequence: Synthetic peptide"
MQALQTPLT

SEQ ID NO: 618 - protein, 11 aa, Artificial Sequence
  source: /note="Description of Artificial Sequence: Synthetic peptide"
QHYGNSPPKFT

SEQ ID NO: 619 - protein, 10 aa, Artificial Sequence
  source: /note="Description of Artificial Sequence: Synthetic peptide"
QHYGGSPRLT

SEQ ID NO: 620 - protein, 9 aa, Artificial Sequence
  source: /note="Description of Artificial Sequence: Synthetic peptide"
QQHYSTPWT

SEQ ID NO: 621 - protein, 9 aa, Artificial Sequence
  source: /note="Description of Artificial Sequence: Synthetic peptide"
LQSRIFPRT

SEQ ID NO: 622 - protein, 9 aa, Artificial Sequence
  source: /note="Description of Artificial Sequence: Synthetic peptide"
LQSRTIPRT

SEQ ID NO: 623 - protein, 9 aa, Artificial Sequence
  source: /note="Description of Artificial Sequence: Synthetic peptide"
LQSRTIPRT

SEQ ID NO: 624 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 625 - protein, 21 aa, Artificial Sequence
  source: /note="Description of Artificial Sequence: Synthetic peptide"
MALPVTALLLPLALLLHAARP

SEQ ID NO: 626 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 627 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 628 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 629 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 630 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 631 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 632 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 633 - protein, 10 aa, Artificial Sequence
  source: /note="Description of Artificial Sequence: Synthetic peptide"
GGGGSGGGGS

SEQ ID NO: 634 - DNA, 30 bp, Artificial Sequence
  source: /note="Description of Artificial Sequence: Synthetic oligonucleotide"
ggtggcggaggttctggaggtggaggttcc

SEQ ID NO: 635 - protein, 24 aa, Artificial Sequence
  source: /note="Description of Artificial Sequence: Synthetic peptide"
IYIWAPLAGTCGVLLLSLVITLYC

SEQ ID NO: 636 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 637 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 638 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 639 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 640 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 641 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 642 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 643 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 644 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 645 - protein, 5 aa, Artificial Sequence
  source: /note="Description of Artificial Sequence: Synthetic peptide"
GGGGS

SEQ ID NO: 646 - DNA, 30 bp, Artificial Sequence; identical to SEQ ID NO: 634
  source: /note="Description of Artificial Sequence: Synthetic oligonucleotide"

SEQ ID NO: 647 - protein, 150 aa, Artificial Sequence [sequence omitted]

SEQ ID NO: 648 - DNA, 450 bp, Artificial Sequence
  source: /note="Description of Artificial Sequence: Synthetic polynucleotide"
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 649 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 650 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 651 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 652 - DNA, 738 bp, Artificial Sequence
  source: /note="Description of Artificial Sequence: Synthetic polynucleotide"
gaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaag

SEQ ID NO: 653 - protein, 244 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 654 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaagggatcgcaccaccatcaccatcatcatcac

SEQ ID NO: 655 - protein, 253 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 656 - protein, 277 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHH

SEQ ID NO: 657 - protein, 246 aa, Artificial Sequence
  source: /note="Description of Artificial Sequence: Synthetic polypeptide"
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 658 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgagatccagctggtgcagtcgggagctgaagtcaaaaagcctggcgcaaccgtcaagatctcgtgcaaaggatcagggttcaacatcgaggactactacatccattgggtgcaacaggcacccggaaaaggcctggagtggatggggaggattgacccagaaaatgacgaaaccaagtacggaccgatcttccaaggacgggtgaccatcacggctgacacttccactaacaccgtctacatggaactctcgagccttcgctcggaagataccgcggtgtactactgcgcctttagaggtggagtctactggggacaagggactaccgtcaccgtgtcgtcaggtggcggaggatcaggcggaggcggctccggtggaggaggaagcggaggaggtggctccgacgtggtgatgacgcagtcaccggactccttggcggtgagcctgggtgaacgcgccactatcaactgcaagagctcccagagcttgctggactccgatggaaagacttatctcaattggctgcaacagaagcctggccagccgccaaagagactcatctcactggtgagcaagctggatagcggagtgccagatcggttttcgggatcgggctcaggcaccgacttcaccctgactatttcctccctccaagccgaggatgtggccgtctactactgttggcaggggactcacttcccggggaccttcggtggaggcactaaggtggagatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 659 - protein, 242 aa, Artificial Sequence
  source: /note="Description of Artificial Sequence: Synthetic polypeptide"
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 660 - protein, 490 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 661 - protein, 241 aa, Artificial Sequence
  source: /note="Description of Artificial Sequence: Synthetic polypeptide"
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 662 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 663 - protein, 253 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 664 - DNA, 738 bp, Artificial Sequence
  source: /note="Description of Artificial Sequence: Synthetic polynucleotide"
gatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcg

SEQ ID NO: 665 - protein, 250 aa, Artificial Sequence
  source: /note="Description of Artificial Sequence: Synthetic polypeptide"
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 666 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcggggtcacatcaccaccatcatcatcaccac

SEQ ID NO: 667 - protein, 246 aa, Artificial Sequence
  source: /note="Description of Artificial Sequence: Synthetic polypeptide"
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 668 - protein, 277 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 669 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcaaagcccagattccttggctgtctcccttggagaaagagcaacgatcaattgcaaaagctcgcagtccctgttggactccgatggaaaaacctacctcaactggctgcagcagaagccgggacaaccaccaaagcggctgatttccctcgtgtccaagctggacagcggcgtgccggatcgcttctcgggcagcggctcgggaaccgattttactctcactatttcgtcactgcaagcggaggacgtggcggtgtattactgctggcagggcactcacttcccgggtacttttggtggaggtaccaaagtcgaaatcaagggtggaggcgggagcggaggaggcgggtcgggaggaggaggatcgggtggcggaggctcagaaatccagctggtgcagtcaggtgccgaagtgaagaagcctggggccacggtgaagatctcgtgcaaggggagcggattcaacatcgaggattactacatccattgggtgcaacaggcccctggcaaagggctggaatggatgggaaggatcgaccccgagaatgacgagactaagtacggcccgatcttccaaggacgggtgaccatcactgcagacacttcaaccaacaccgtctacatggaactctcctcgctgcgctccgaggacaccgccgtgtactactgtgctttcagaggaggagtctactggggacagggaacgaccgtgaccgtcagctcaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 670 - protein, 255 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 671 - protein, 490 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 672 - protein, 241 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 673 - DNA, 521 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 674 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 675 - protein, 246 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 676 - DNA, 118 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 677 - DNA, 738 bp, Artificial Sequence
  source: /note="Description of Artificial Sequence: Synthetic polynucleotide"
gagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaag

SEQ ID NO: 678 - protein, 249 aa, Artificial Sequence
  source: /note="Description of Artificial Sequence: Synthetic polypeptide"
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 679 - DNA, 221 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 680 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaagggctcacaccatcatcaccatcaccaccac

SEQ ID NO: 681 - protein, 249 aa, Artificial Sequence
  source: /note="Description of Artificial Sequence: Synthetic polypeptide"
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 682 - DNA, 324 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 683 - protein, 277 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 684 - protein, 244 aa, Artificial Sequence
  source: /note="Description of Artificial Sequence: Synthetic polypeptide"
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 685 - DNA, 422 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 686 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtgcaaagcggagccgaggtgaagaagcccggagaatccctgcgcatctcgtgtaagggttccggctttaacatcgaggattactacatccactgggtgagacagatgccgggcaaaggtctggaatggatgggccgcatcgacccggagaacgacgaaaccaaatacggaccaatcttccaaggacatgtgactatttccgcggatacctccatcaacactgtctacttgcagtggagctcgctcaaggcgtcggataccgccatgtactactgcgcattcagaggaggtgtgtactggggccagggcactacggtcaccgtgtcctcgggaggtggagggtcaggaggcggaggctcgggcggtggaggatcaggcggaggaggaagcgatgtggtcatgactcaatccccactgtcactgcctgtcactctggggcaaccggcttccatctcatgcaagtcaagccaatcgctgctcgactccgacggaaaaacctacctcaattggcttcagcagcgcccaggccagtcgcctcggaggctgatctcactcgtgtcgaagcttgactccggggtgccggatcggtttagcggaagcggatcggggaccgacttcacgttgaagattagccgggtggaagccgaggacgtgggagtctattactgctggcaggggacccacttcccggggactttcggaggaggcaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 687 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 688 - protein, 21 aa, Artificial Sequence
  source: /note="Description of Artificial Sequence: Synthetic peptide"
  SITE (1)..(3): /note="This region may or may not be present"
GSGEGRGSLLTCGDVEENPGP

SEQ ID NO: 689 - protein, 490 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 690 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 691 - protein, 22 aa, Artificial Sequence
  source: /note="Description of Artificial Sequence: Synthetic peptide"
  SITE (1)..(3): /note="This region may or may not be present"
GSGATNFSLLKQAGDVEENPGP

SEQ ID NO: 692 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 693 - protein, 251 aa, Artificial Sequence
  source: /note="Description of Artificial Sequence: Synthetic polypeptide"
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 694 - protein, 23 aa, Artificial Sequence
  source: /note="Description of Artificial Sequence: Synthetic peptide"
  SITE (1)..(3): /note="This region may or may not be present"
GSGQCTNYALLKLAGDVESNPGP

SEQ ID NO: 695 - DNA, 738 bp, Artificial Sequence
  source: /note="Description of Artificial Sequence: Synthetic polynucleotide"
gacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctcc

SEQ ID NO: 696 - protein, 250 aa, Artificial Sequence
  source: /note="Description of Artificial Sequence: Synthetic polypeptide"
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 697 - protein, 25 aa, Artificial Sequence
  source: /note="Description of Artificial Sequence: Synthetic peptide"
  SITE (1)..(3): /note="This region may or may not be present"
GSGVKQTLNFDLLKLAGDVESNPGP

SEQ ID NO: 698 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctccggctcgcatcaccatcatcaccaccatcac

SEQ ID NO: 699 - protein, 249 aa, Artificial Sequence
  source: /note="Description of Artificial Sequence: Synthetic polypeptide"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 700 - protein, 277 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHH

SEQ ID NO: 701 - protein, 247 aa, Artificial Sequence
  source: /note="Description of Artificial Sequence: Synthetic polypeptide"
QVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 702 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtcatgacccaatcccctctctccctgccggtcaccctgggtcagccggcgtcgatctcatgcaaaagctcacagtccctgctggattcggacggaaaaacctacttgaactggctccaacagaggccgggtcagtcccctcgcagactgatctcgctggtgagcaagctcgactcgggtgtgccggatcggttctccgggtcaggatcgggcaccgactttacgctcaagatttcgagagtggaggccgaggatgtgggagtgtactattgctggcagggcacgcatttccccgggacctttggaggcgggactaaggtggaaatcaagggaggtggcggatcaggcggaggaggcagcggcggaggtggatcaggaggcggagggtcagagatccagctggtccaaagcggagcagaggtgaagaagccaggcgagtcccttcgcatttcgtgcaaagggagcggcttcaacattgaagattactacatccactgggtgcggcaaatgccaggaaagggtctggaatggatgggacggatcgacccagaaaatgatgaaactaagtacggaccgatcttccaaggacacgtcactatctccgcggacacttcgatcaacaccgtgtacctccagtggagcagcttgaaagcctccgacaccgctatgtactactgtgccttccgcggaggagtctactggggacaggggactactgtgaccgtgtcgtccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 703 - protein, 253 aa, Artificial Sequence
  source: /note="Description of Artificial Sequence: Synthetic polypeptide"
QVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 704 - protein, 490 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 705 - protein, 249 aa, Artificial Sequence
  source: /note="Description of Artificial Sequence: Synthetic polypeptide"
QVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 706 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 707 - protein, 246 aa, Artificial Sequence
  source: /note="Description of Artificial Sequence: Synthetic polypeptide"
QITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIK

SEQ ID NO: 708 - DNA, 738 bp, Artificial Sequence
  source: /note="Description of Artificial Sequence: Synthetic polynucleotide"
gaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaa

SEQ ID NO: 709 - protein, 488 aa, Artificial Sequence
  source: /note="Description of Artificial Sequence: Synthetic polypeptide"
MALPVTALLLPLALLLHAARPQVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 710 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaagggagccaccatcatcatcaccaccaccac

SEQ ID NO: 711 - protein, 497 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 712 - protein, 277 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 713 - protein, 490 aa, Artificial Sequence
  source: /note="Description of Artificial Sequence: Synthetic polypeptide"
MALPVTALLLPLALLLHAARPQVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 714 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 715 - protein, 486 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 716 - protein, 490 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 717 - protein, 485 aa, Artificial Sequence
  source: /note="Description of Artificial Sequence: Synthetic polypeptide"
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 718 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 719 - protein, 497 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 720 - DNA, 738 bp, Artificial Sequence
  source: /note="Description of Artificial Sequence: Synthetic polynucleotide"
gaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaag

SEQ ID NO: 721 - protein, 494 aa, Artificial Sequence
  source: /note="Description of Artificial Sequence: Synthetic polypeptide"
MALPVTALLLPLALLLHAARPQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 722 - DNA, 834 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaagggatcacaccaccatcatcaccatcaccaccat

SEQ ID NO: 723 - protein, 490 aa, Artificial Sequence
  source: /note="Description of Artificial Sequence: Synthetic polypeptide"
MALPVTALLLPLALLLHAARPQVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 724 - protein, 278 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHHH

SEQ ID NO: 725 - protein, 492 aa, Artificial Sequence
  source: /note="Description of Artificial Sequence: Synthetic polypeptide"
MALPVTALLLPLALLLHAARPQVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 726 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgagattcagctcgtgcaatcgggagcggaagtcaagaagccaggagagtccttgcggatctcatgcaagggtagcggctttaacatcgaggattactacatccactgggtgaggcagatgccggggaagggactcgaatggatgggacggatcgacccagaaaacgacgaaactaagtacggtccgatcttccaaggccatgtgactattagcgccgatacttcaatcaataccgtgtatctgcaatggtcctcattgaaagcctcagataccgcgatgtactactgtgctttcagaggaggggtctactggggacagggaactaccgtgactgtctcgtccggcggaggcgggtcaggaggtggcggcagcggaggaggagggtccggcggaggtgggtccgacgtcgtgatgacccagagccctgacagcctggcagtgagcctgggcgaaagagctaccattaactgcaaatcgtcgcagagcctgctggactcggacggaaaaacgtacctcaattggctgcagcaaaagcctggccagccaccgaagcgccttatctcactggtgtcgaagctggattcgggagtgcccgatcgcttctccggctcgggatcgggtactgacttcaccctcactatctcctcgcttcaagcagaggacgtggccgtctactactgctggcagggaacccactttccgggaaccttcggcggagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 727 - protein, 499 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 728 - protein, 490 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 729 - protein, 485 aa, Artificial Sequence
  source: /note="Description of Artificial Sequence: Synthetic polypeptide"
MALPVTALLLPLALLLHAARPQVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 730 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 731 - protein, 490 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 732 - DNA, 738 bp, Artificial Sequence
  source: /note="Description of Artificial Sequence: Synthetic polynucleotide"
gacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctcc

SEQ ID NO: 733 - protein, 493 aa, Artificial Sequence
  source: /note="Description of Artificial Sequence: Synthetic polypeptide"
MALPVTALLLPLALLLHAARPQVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 734 - DNA, 834 bp, Artificial Sequence
  source: /note="Description of Artificial Sequence: Synthetic polynucleotide"
atggccctccctgtcaccgccctgctgcttccgctggctcttctgctccacgccgctcggcccgacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctccggctcccatcaccaccaccatcaccatcatcac

SEQ ID NO: 735 - protein, 493 aa, Artificial Sequence
  source: /note="Description of Artificial Sequence: Synthetic polypeptide"
MALPVTALLLPLALLLHAARPQVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 736 - protein, 278 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHHH

SEQ ID NO: 737 - protein, 488 aa, Artificial Sequence
  source: /note="Description of Artificial Sequence: Synthetic polypeptide"
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 738 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtggtgatgactcagtcgcctgactcgctggctgtgtcccttggagagcgggccactatcaattgcaagtcatcccagtcgctgctggattccgacgggaaaacctacctcaattggctgcagcaaaaaccgggacagcctccaaagcggctcatcagcctggtgtccaagttggacagcggcgtgccagaccgcttctccggttcgggaagcggtactgatttcacgctgaccatctcatccctccaagcggaggatgtggcagtctactactgttggcagggcacgcattttccgggcacttttggaggagggaccaaggtcgaaatcaagggaggaggtggctcgggcggaggaggctcgggaggaggaggatcaggaggcggtggaagcgagattcaactggtccagagcggcgcagaagtcaagaagccgggtgaatcgctcagaatctcgtgcaaaggatcgggattcaacatcgaggactactacattcactgggtcagacaaatgccgggcaaagggctggaatggatggggaggatcgaccccgaaaacgatgaaaccaagtacggaccaatcttccaagggcacgtgaccatttcggcggacacctcaatcaacactgtgtacctccagtggagctcacttaaggccagcgataccgccatgtactattgcgctttccgcggaggggtgtactggggacagggcactactgtgaccgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 739 - protein, 490 aa, Artificial Sequence
  source: /note="Description of Artificial Sequence: Synthetic polypeptide"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 740 - protein, 490 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 741 - protein, 490 aa, Artificial Sequence
  source: /note="Description of Artificial Sequence: Synthetic polypeptide"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 742 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 743 - protein, 495 aa, Artificial Sequence
  source: /note="Description of Artificial Sequence: Synthetic polypeptide"
MALPVTALLLPLALLLHAARPQVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 744 - DNA, 738 bp, Artificial Sequence
  source: /note="Description of Artificial Sequence: Synthetic polynucleotide"
gatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcg

SEQ ID NO: 745 - protein, 494 aa, Artificial Sequence
  source: /note="Description of Artificial Sequence: Synthetic polypeptide"
MALPVTALLLPLALLLHAARPQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 746 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcggggtcccaccatcatcaccaccaccatcac

SEQ ID NO: 747 - protein, 493 aa, Artificial Sequence
  source: /note="Description of Artificial Sequence: Synthetic polypeptide"
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 748 - protein, 277 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 749 - protein, 491 aa, Artificial Sequence
  source: /note="Description of Artificial Sequence: Synthetic polypeptide"
MALPVTALLLPLALLLHAARPQVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 750 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 751 - protein, 497 aa, Artificial Sequence
  source: /note="Description of Artificial Sequence: Synthetic polypeptide"
MALPVTALLLPLALLLHAARPQVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 752 - protein, 490 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 753 - protein, 493 aa, Artificial Sequence
  source: /note="Description of Artificial Sequence: Synthetic polypeptide"
MALPVTALLLPLALLLHAARPQVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 754 - protein, 243 aa, Artificial Sequence
  source: /note="Description of Artificial Sequence: Synthetic polypeptide"
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 755 - protein, 490 aa, Artificial Sequence
  source: /note="Description of Artificial Sequence: Synthetic polypeptide"
MALPVTALLLPLALLLHAARPQITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 756 - DNA, 822 bp, Artificial Sequence
  source: /note="Description of Artificial Sequence: Synthetic polynucleotide"
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagggtagccatcaccatcaccaccaccatcat

SEQ ID NO: 757 - protein, 274 aa, Artificial Sequence
  source: /note="Description of Artificial Sequence: Synthetic polypeptide"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKGSHHHHHHHH

SEQ ID NO: 758 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 759 - protein, 487 aa, Artificial Sequence
  source: /note="Description of Artificial Sequence: Synthetic polypeptide"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 760 - protein, 240 aa, Artificial Sequence
  source: /note="Description of Artificial Sequence: Synthetic polypeptide"
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 761 - DNA, 720 bp, Artificial Sequence
  source: /note="Description of Artificial Sequence: Synthetic polynucleotide"
gatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcc

SEQ ID NO: 762 - DNA, 807 bp, Artificial Sequence
  source: /note="Description of Artificial Sequence: Synthetic polynucleotide"
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcccatcaccatcaccaccaccatcac

SEQ ID NO: 763 - protein, 269 aa, Artificial Sequence
  source: /note="Description of Artificial Sequence: Synthetic polypeptide"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHHHH

SEQ ID NO: 764 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 765 - protein, 484 aa, Artificial Sequence
  source: /note="Description of Artificial Sequence: Synthetic polypeptide"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 766 - DNA, 729 bp, Artificial Sequence
  source: /note="Description of Artificial Sequence: Synthetic polynucleotide"
gagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaag

SEQ ID NO: 767 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 768 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 769 - protein, 35 aa, Artificial Sequence
  source: /note="Description of Artificial Sequence: Synthetic polypeptide"
TKKKYSSSVHDPNGEYMFMRAVNTAKKSRLTDVTL

SEQ ID NO: 770 - protein, 41 aa, Artificial Sequence
  source: /note="Description of Artificial Sequence: Synthetic polypeptide"
RSKRSRLLHSDYMNMTPRRPGPTRKHYQPYAPPRDFAAYRS

SEQ ID NO: 771 - protein, 5 aa, Artificial Sequence
  source: /note="Description of Artificial Sequence: Synthetic peptide"
NHGMS

SEQ ID NO: 772 - protein, 5 aa, Artificial Sequence
  source: /note="Description of Artificial Sequence: Synthetic peptide"
DYYMS

SEQ ID NO: 773 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 774 - protein, 242 aa, Artificial Sequence; identical to SEQ ID NO: 15
  source: /note="Description of Artificial Sequence: Synthetic polypeptide"

SEQ ID NO: 775 - protein, 244 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 776 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 777 - protein, 246 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 778 - protein, 439 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 779 - protein, 819 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 780 - protein, 245 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 781 - protein, 467 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 782 - protein, 5 aa, Artificial Sequence
  source: /note="Description of Artificial Sequence: Synthetic peptide"
DYGVS

SEQ ID NO: 783 - protein, 16 aa, Artificial Sequence
  source: /note="Description of Artificial Sequence: Synthetic peptide"
VIWGSETTYYNSALKS

SEQ ID NO: 784 - protein, 12 aa, Artificial Sequence
  source: /note="Description of Artificial Sequence: Synthetic peptide"
HYYYGGSYAMDY

SEQ ID NO: 785 - protein, 11 aa, Artificial Sequence
  source: /note="Description of Artificial Sequence: Synthetic peptide"
RASQDISKYLN

SEQ ID NO: 786 - protein, 7 aa, Artificial Sequence
  source: /note="Description of Artificial Sequence: Synthetic peptide"
HTSRLHS

SEQ ID NO: 787 - protein, 9 aa, Artificial Sequence
  source: /note="Description of Artificial Sequence: Synthetic peptide"
QQGNTLPYT

SEQ ID NO: 788 - protein, 5 aa, Artificial Sequence
  source: /note="Description of Artificial Sequence: Synthetic peptide"
DYGVS

SEQ ID NO: 789 - protein, 16 aa, Artificial Sequence
  source: /note="Description of Artificial Sequence: Synthetic peptide"
VIWGSETTYYSSSLKS

SEQ ID NO: 790 - protein, 12 aa, Artificial Sequence
  source: /note="Description of Artificial Sequence: Synthetic peptide"
HYYYGGSYAMDY

SEQ ID NO: 791 - protein, 11 aa, Artificial Sequence
  source: /note="Description of Artificial Sequence: Synthetic peptide"
RASQDISKYLN

SEQ ID NO: 792 - protein, 7 aa, Artificial Sequence
  source: /note="Description of Artificial Sequence: Synthetic peptide"
HTSRLHS

SEQ ID NO: 793 - protein, 9 aa, Artificial Sequence
  source: /note="Description of Artificial Sequence: Synthetic peptide"
QQGNTLPYT

SEQ ID NO: 794 - protein, 5 aa, Artificial Sequence
  source: /note="Description of Artificial Sequence: Synthetic peptide"
DYGVS

SEQ ID NO: 795 - protein, 16 aa, Artificial Sequence
  source: /note="Description of Artificial Sequence: Synthetic peptide"
VIWGSETTYYQSSLKS

SEQ ID NO: 796 - protein, 12 aa, Artificial Sequence
  source: /note="Description of Artificial Sequence: Synthetic peptide"
HYYYGGSYAMDY

SEQ ID NO: 797 - protein, 11 aa, Artificial Sequence
  source: /note="Description of Artificial Sequence: Synthetic peptide"
RASQDISKYLN

SEQ ID NO: 798 - protein, 7 aa, Artificial Sequence
  source: /note="Description of Artificial Sequence: Synthetic peptide"
HTSRLHS

SEQ ID NO: 799 - protein, 9 aa, Artificial Sequence
  source: /note="Description of Artificial Sequence: Synthetic peptide"
QQGNTLPYT

SEQ ID NO: 800 - protein, 5 aa, Artificial Sequence
  source: /note="Description of Artificial Sequence: Synthetic peptide"
DYGVS

SEQ ID NO: 801 - protein, 16 aa, Artificial Sequence
  source: /note="Description of Artificial Sequence: Synthetic peptide"
VIWGSETTYYNSSLKS

SEQ ID NO: 802 - protein, 12 aa, Artificial Sequence
  source: /note="Description of Artificial Sequence: Synthetic peptide"
HYYYGGSYAMDY

SEQ ID NO: 803 - protein, 11 aa, Artificial Sequence
  source: /note="Description of Artificial Sequence: Synthetic peptide"
RASQDISKYLN

SEQ ID NO: 804 - protein, 7 aa, Artificial Sequence
  source: /note="Description of Artificial Sequence: Synthetic peptide"
HTSRLHS

SEQ ID NO: 805 - protein, 9 aa, Artificial Sequence
  source: /note="Description of Artificial Sequence: Synthetic peptide"
QQGNTLPYT

SEQ ID NO: 806 - protein, 69 aa, Artificial Sequence
  source: /note="Description of Artificial Sequence: Synthetic polypeptide"
TTTPAPRPPTPAPTIASQPLSLRPEACRPAAGGAVHTRGLDFACDFWLPIGCAAFVVVCILGCILICWL

SEQ ID NO: 807 - DNA, 207 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctggttacccataggatgtgcagcctttgttgtagtctgcattttgggatgcatacttatttgttggctt

SEQ ID NO: 808 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 809 - DNA, 123 bp, Artificial Sequence; identical to SEQ ID NO: 640
  source: /note="Description of Artificial Sequence: Synthetic polynucleotide"

SEQ ID NO: 810 - protein, 248 aa, Artificial Sequence
  source: /note="Description of Artificial Sequence: Synthetic polypeptide"
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 811 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 812 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 813 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 814 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 815 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 816 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 817 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 818 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 819 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 820 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 821 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 822 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 823 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 824 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 825 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 826 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 827 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 828 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 829 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 830 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 831 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 832 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 833 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 834 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 835 - protein, 491 aa, Artificial Sequence; identical to SEQ ID NO: 833
  source: /note="Description of Artificial Sequence: Synthetic polypeptide"

SEQ ID NO: 836 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 837 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 838 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 839 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 840 - DNA, 1458 bp, Artificial Sequence
  source: /note="Description of Artificial Sequence: Synthetic polynucleotide"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 841 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 842 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 843 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 844 - DNA, 5000 bp, Artificial Sequence; identical to SEQ ID NO: 32
  source: /note="Description of Artificial Sequence: Synthetic polynucleotide"
  misc_feature (1)..(5000): /note="This sequence may encompass 100-5000 nucleotides"

SEQ ID NO: 845 - DNA, 400 bp, Artificial Sequence
  source: /note="Description of Artificial Sequence: Synthetic polynucleotide"
  misc_feature (1)..(400): /note="This sequence may encompass 100-400 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 846 - protein, 4 aa, Artificial Sequence
  source: /note="Description of Artificial Sequence: Synthetic peptide"
RGDS

SEQ ID NO: 847 - protein, 486 aa, Artificial Sequence; identical to SEQ ID NO: 773
  source: /note="Description of Artificial Sequence: Synthetic polypeptide"
  SITE (1)..(21): /note="This region may or may not be present"
  source: /note="See specification as filed for detailed description of substitutions and preferred embodiments"

SEQ ID NO: 848 - protein, 465 aa, Artificial Sequence; identical to SEQ ID NO: 26
  source: /note="Description of Artificial Sequence: Synthetic polypeptide"

SEQ ID NO: 849 - DNA, 7646 bp, Artificial Sequence
  source: /note="Description of Artificial Sequence: Synthetic polynucleotide"
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcctagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgagaatatgggcccgggctagcctgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgctcgagaagcttgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagcggccgcttttttttttttaattaaaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgtctagatccggagccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctttttttgtcgacggtaccgcgggcccgggatccgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatccatcgatggagttcattatggacagcgcagaaagagctggggagaattgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgatttaaagacaggatatcagtggtccaggctctagttttgactcaacaatatcaccagctgaagcctatagagtacgagccatagataaaataaaagattttatttagtctccagaaaaaggggggaa

SEQ ID NO: 850 - DNA, 7646 bp, Artificial Sequence
  source: /note="Description of Artificial Sequence: Synthetic polynucleotide"
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcctagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgagaatatgggcccgggctagcctgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgctcgagaagcttgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagcggccgcttttttttttttaattaaaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgtctagatccggattcacatgggcgacctaccgcgacagtaggtggtttcgctgtggagcttcgcgggaacattctcactccgcagtgtcccgttaaacggcggggctggtgcccggacaggggcggggtgtctaccagtggtcacgctcactttggcgagacgaccgcagtccgaataaatgcatgaggcgggccgcacaagctgaagagaactccgatgggcggggtatccacccggcccgtgggggatatgatgccagctcggtccaacgagcggttagggcgacccttgcggcgatatgtcgagtccgttttttgtcgacggtaccgcgggcccgggatccgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatccatcgatggagttcattatggacagcgcagaaagagctggggagaattgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgatttaaagacaggatatcagtggtccaggctctagttttgactcaacaatatcaccagctgaagcctatagagtacgagccatagataaaataaaagattttatttagtctccagaaaaaggggggaa

SEQ ID NO: 851 - RNA, 301 nt, Artificial Sequence
  source: /note="Description of Artificial Sequence: Synthetic polynucleotide"
gccgggcgcgguggcgcgugccuguagucccagcuacucgggaggcugaggcuggaggaucgcuugaguccaggaguucugggcuguagugcgcuaugccgaucggguguccgcacuaaguucggcaucaauauggugaccucccgggagcgggggaccaccagguugccuaaggaggggugaaccggcccaggucggaaacggagcaggucaaaacucccgugcugaucaguagugggaucgcgccugugaauagccacugcacuccagccugugcaacauagcgagaccccgucucuuu

SEQ ID NO: 852 - RNA, 287 nt, Artificial Sequence
  source: /note="Description of Artificial Sequence: Synthetic polynucleotide"
ggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaa

SEQ ID NO: 853 - RNA, 17 nt, Artificial Sequence
  source: /note="Description of Artificial Sequence: Synthetic oligonucleotide"
gcaggagaauagacucc

What is claimed is:

1. An exogenous nucleic acid molecule comprising:

(a) a first nucleic acid sequence encoding a chimeric antigen receptor (CAR) that binds to an antigen, and (b) a second nucleic acid sequence encoding an RNA molecule, wherein the RNA molecule activates a pattern recognition receptor (PRR), and further wherein the RNA molecule is a RN7SL1 RNA molecule, or the RNA molecule comprises a nucleotide sequence having at least 95% identity to SEQ ID NO: 2, 4, 6, 8, or 10 wherein the RNA molecule retains all or part of the immunogenic property of the naturally-existing RN7SL1 RNA molecule.

2. An isolated immune cell comprising the exogenous nucleic acid molecule of claim 1.

3. A population of cells comprising the isolated immune cell of claim 2.

4. A pharmaceutical composition comprising the population of isolated cells of claim 3 and a pharmaceutically acceptable carrier, excipient, or stabilizer.

5. A method for treating cancer, the method comprising administering to the subject an effective amount of the pharmaceutical composition of claim 4.

6. A method of making the cell of claim 2, comprising: (1) providing an isolated immune cell, comprising a first exogenous nucleic acid molecule comprising a nucleic acid sequence encoding the chimeric antigen receptor (CAR) comprising a first antigen binding domain that binds to a first antigen, and (2) contacting the cell ex vivo with the second exogenous nucleic acid molecule comprising at least one nucleic acid sequence comprising or encoding the exogenous RNA molecule.

7. A kit comprising the exogenous nucleic acid molecule of claim 1.

8. A method of making a CAR-expressing cell, comprising introducing the nucleic acid molecule of claim 1 into an immune effector cell under a condition such that the CAR molecule is expressed.

9. The exogenous nucleic acid molecule of claim 1, wherein the CAR comprises, in an N- to C-terminal orientation, an antigen binding domain that binds to the antigen, a transmembrane domain, and an intracellular signaling domain, wherein the antigen binding domain is connected to the transmembrane domain by a hinge domain.

10. The exogenous nucleic acid molecule of claim 1, wherein the antigen is a tumor antigen.

11. The immune cell of claim 2, wherein when the PRR is expressed in an isolated immune cell, the isolated immune cell is a dendritic cell (DC), a macrophage, or a T cell.

12. The exogenous nucleic acid molecule of claim 1, wherein the RNA molecule comprises RN7SL1.

13. The exogenous nucleic acid molecule of claim 1, wherein the second nucleic acid sequence encoding the RNA molecule comprises the sequence of SEQ ID NO: 1.

14. The exogenous nucleic acid molecule of claim 1, wherein the RNA molecule comprises an Alu-Ya5, wherein the Alu-Ya5 comprises the nucleotide sequence of SEQ ID NO: 8.

15. The exogenous nucleic acid molecule of claim 1, wherein the second nucleic acid sequence encoding the RNA molecule comprises the sequence of SEQ ID NO: 7.

16. The exogenous nucleic acid molecule of claim 1, wherein the RNA molecule comprises a hairpin RN7SL1, wherein the hairpin RN7SL1 comprises the nucleotide sequence of SEQ ID NO: 10.

17. The exogenous nucleic acid molecule of claim 1, wherein the second nucleic acid sequence encoding the RNA molecule comprises the sequence of SEQ ID NO: 9.

18. The isolated immune cell of claim 2, wherein the CAR comprises, in an N- to C-terminal orientation, an antigen binding domain that binds to the antigen, a transmembrane domain, and an intracellular signaling domain, wherein the antigen binding domain is connected to the transmembrane domain by a hinge domain.

19. The isolated immune cell of claim 2, wherein the isolated immune cell comprises a T cell or an NK cell.

20. The isolated immune cell of claim 2, wherein the antigen is a tumor antigen.

21. The isolated immune cell of claim 2, wherein the RNA molecule comprises RN7SL1 or a fragment thereof.

22. The isolated immune cell of claim 1, wherein the RNA molecule comprises the sequence of SEQ ID NO: 2, 4, or 6.

23. The isolated immune cell of claim 2, wherein the RNA molecule comprises an Alu-Ya5, wherein the Alu-Ya5 comprises the nucleotide sequence of SEQ ID NO: 8.

24. The isolated immune cell of claim 2, wherein the RNA molecule comprises a hairpin RN7SL1, wherein the hairpin RN7SL1 comprises the nucleotide sequence of SEQ ID NO: 10.

* * * * *